United States Patent 7,868,149 (PLANT GENOME SEQUENCE AND USES THEREOF) - sequence listing, part 125

SEQ ID NO: 69556 - DNA, 47032 bp, Oryza sativa
  unsure (1)..(47032): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatattataatgattataataagctgggaaccagattataataaactacttcaataagttgtctattttttcagcttactctaaataatttggattataataattccaatccgaaagaagcagtgcctaaaacagggcagagtttcgcttgggtgttgctctcgtccgtcactttgtccaattgtccatcattggtacgcttgctcccccaggctcctgccagttgcttctctttgtccggccggtgtcaccgctgcatgcgtcggcgacacgatcgagcccgtgtgatagatatattaggcactgggcagcgtggcaaggtaataattaacgatttaatagcaaatatatagattgtggattgcggtcgctataatttgtataaaattacctgtgtcaaaataatatgtttcgctgctgtttatcgaatttttagtggaaaaagttttcaccgctgtagtaccaatcattactgagaaaatatattaagttgtcctaagatatcgcattagtgacaattatgtagtgataaaatactccctctgtttcacaatgtaagggattctaacattttccacgttcataatgatgttaatgaatctagacatatcaatctagatttattaatatcaatataaatatggaaaatgctagaatgacttacactgtgaaacggagaaataatatttttgccactacattgtatttattagtgggagaacattgtatcaggaggcctcatcaatgatgaatttattgtggcgaatcctttcagtgctaccctttaattcatcatatttgttgttttacttgcgacagatctttgggctcctatcttttactttttcattcgaagattttaatttgcatcaagatttgtttttttatatgtaacatagcacttattcagttacagtgcacttacacttggttaattacagtgcataagagtaaaattttacaacagtttttctttagattttaagatttttaacatgtttatctctttttggttattttattgaaaacgggctatatccattagttaaaaatttgcaagattcaaagcaataaacttatcgaaagattaataggtagtcccttaatttataattagtgatcatttgctatattgttgtagtaatatctagttgtgacaaactcatacggcgctaattcattttttgagttggaaaatttcatgtcacccgtgggtctgtttggtttgctatgttatcatgtctgtttggttctaaggaataagactgtgtttagttcgtgtgctaaaatttttgtgaagtatacggacacatatttgaagtattaaacgtagactaatagcaaaacaaattacagattctgcctgtaaactgtgagatgaatttattaagactaattaatccatcattagcaaatgtttactgtagcatcacattgtcaagtcatgacgtaattagactcaaaagattcatctcgcaatttacatacaaactgtgcaattggttttttatcacatttgatacttcatgcatgtgtccaaatatttgatgtgacggaaatgttggaagtttggccaaaaatttttgactctaaacacggccttagtcaatttttcctcccgattgaatcatcttcctcaaccacaaaatcggtctcccattttcgaaaacaagggcaaatgaataaaagcagtttctattgacgtggcaagttgaccgtagctaacccgctgagttagcaagtggaacccacatgtctggctcacatgtaagcctctcaagggaaaaatctgtagggtccacatgccatctgtatccactttcctccccttcctctctattctcttttttttttctccatcgctcttatgggcaatggagaaagggcaagacggcgaagggcagtgaagcagaggacgcgggcggcgcgacggcgtaatctgagacattgtcgcgtgcaaccatgcctcttttcctccgctaccgcaggaaagaaggcgccaggcggaaacggcggtggtggacggcacgacagcgcggaatccgagatatcgccgcgcacctggctccatatgaatcagagaagacagaatataagcaaggacattagtaaagaagaatggtgctaaaaaatctgagttcagcaaagaagaatgtttcatcacttgtggctctgagctttgccacagcttcctctagagagactgggatgttcagagttcatcagacaggaaggtgttggtacctgcctagctacacatactgctcccggacctcctcccttagcggcatcctctcggctctcgccgttctggctctcacagtggatagagcggcttcaaagctacggatagaagtggggtacttggttgggtcgaacaggtctgctactcacggtggtggcatctgcgccgatcgttgagccatcctgcagcacgatcgccagcaggccgaggcagagctcggccttctacgcaccgaggagggcggcgttgatgaccagccacgccgaccggggtctgctccgactccgagatccccgatgtgagcgcgtcgggggcgcgcgcactcgggcgcctcgatggtgtagaacggcacggcgaagaacgcgaactgcggatgcaccgccggtccgccgcgttgtaaatgtggcgcggaggacacgcagtggcggtgagccggcgagcccatgagcgtggagttcccaggtgagttgaagcattgggctctgttggccctggaaccgtggctgatgctcccatgccttcttctcttcagacagtggccatcctgaaatcatcagggaagggtagagattgattaagagaggtggctgacctgtgggtcccacttgctgattcaacaagtcaatttgccatgtcagcataatcaaccatttaaggagtcgatttacaccagttttaaaaaacaggagagacatcacttatacctgattttgtagttgagggagacgatccaatcaagagcagttgagagagaaaaatagacttatctaatattctaaagctgacgggttttcatgcaaaaatgcgcgccacgtggtacaaatagtcgaacgacgcgtgttccatgcaccatcgtgcgctcaagccccgcgtcgcgcacatgtgagtaggggtgaaactgaaaacggtacggaaactttccggattacggacctatttttagaaacggaatatgtcgcttggaattttttcagaattattcggaaacggaagagaaattggaaatattttctcagaaacaggatcggaaatgataatggcagtttccgtcggaactcggaattggtcggaaactttccggaaatttctcggaatttctagaaattttgtgactgaaataccctgtactcttttttttaagcactgaacagtaaataccatagtgtttggcttttatttttttgaaaaaatattttttatgcaaatctgaagttgcataagaatattttctttgtgcattgagatttatcaatagcattactctcttaagcatagataatttatttcatagattgtgttttgtgatgcccttttgagacttaacaattggacttatatgattgtgttttatgatgaattgttgaccgttgagacttgagaattggatttatcagtttgaagggtttctgtattccgataaattttcgttcccgtattcgcgccggttcattttcgctccgttttcggtttcgataatattcgattccgttttcgtatccggggtttccgattccgattcgaaaataatatgaaaacaaaaacgataaagatggtttccgtctatttccgtaccgttttcatccctacgtgttgtgcgagccgaactggccatttgggctgcagcttggctggcccaacaacagagggaaggcgcagggccagtttccttaggccctccccatttcctttttgttttccttctcattcttttcttttgttatttcactcctccatgttctaaaatttaatttatattatgaagaataccacaactcatggtaagtaaaaaaaaatataatcataaaataatctgaataaacaaataggtatgtactttacatatagccacggtctaatggaagaataatcaaatgtagtaaatcttttgtttaacttatgtaacaaatatttattaccctaccaaactttgaaataccaatctcctcatcttatgataaaaaatgttggcatcttatgataaaaaatgttggcatcaaataccaatctcctagatcactaatttcatatgtatgcatcatatcctttttaaattattgcatcatcttctcactattgccagtatatatcaaatcatcaagataaagtgagacgattaggggcctgttcactttgatgccattttcaaccttaccaaattttgataaagttaccaaaaaagtggttacatttagtttactactaaattttggtaactatataagaaatcctgccaaaattttggcaagttggaattgccaaaatttggtaagttttttttttttttgcatcaaagtgaacagaccctagaatatccgtacctgttttcttgacatatagagtaggctcacttatgctcttggcaaattatttatgaataaagtacttgtcaatttgattataccacgctcgaggcgcttactttaatccatataatgcctttttaagtatgaataccttgttttctcccccttgaactgaaaacccttcaggttgttcaacatagatttcttcatcaagatagccatttaagaaagccgatttaacatcaagttgatatatattccatctcttttgagctgctagagcaattattgtgcgaattgtctctagcatggcaataggagcatatgtctcataataatcaatctcaggcttttgcttaaagccttttgccacaagtcttgccttatatttctgaactgagccatctggatttaattttgtcttataaacccatttaaatctaataacttctctgtctctaggacgatcagccaactccaaggtattatttttctcaatcatataaatctcatcttccatggcctttatccaattatcatgtttttctgcttcttgaaaactttgtggctcaacaacagaatagttgcaaaattcatgttgttctgacctccttatttgagaagtagattctaataaatcaaccatacttcttacccgtcttggagctgattccggtgtagaaatttgctcttcactgctcgggcttgaatctaaactagcacttgagcttgaccttggactttatgactgtggacttggagtatgatattccacttcatcactcatatgtggttggcttagcgtgatggtagtggttggcaataatggagtactagaagcttctggagacttccagttccatgtagcactctcataaaaaatcacatctctgctgataataattttctttttctccagattataaagtctatagcctttgataccatcggcatagccaacaaatttgcaacgatcacttttattatcaaagtttactctcttttgtgctggcacttgagtatagcaaatgcaaccaaatattctcatatgaccaatgacaggctttttaccataccaagcttcaaaaggtgtacgatttggtactgcctttgtaggacttatatttaaaatataaactgcagtgttaactgcttcagcccagaaagatttaggcatacctttgtcttgaagcatagaattggccatatcattgatcgtccgatttttcctttctgcactccattttgttgagcactatagcctgcgttcactgtcttcggatgccagcattttcacaatatttctcaaattcttttgagatatattctcttccttgatcgtcgcgcaatactttaatttttcgattactctgattttccaccatggccttgaaatttttaaatgtctccagggctgcagactgttcttttagaaaataaacccagatcattcttgtataatcatcgataaatgtgataaagtaccaatttcctccttctgaaattgttggtactttactaactatatcagtatgcactagttccaatggtgcacttgctctccaagctccactgtgtgggaaagaagctcgaatttgttttccaaatacacaaccttcacatgggtcatatttcagagtaataaatggaaggccttgaaccataccttttgttctgagtagcttcaatgctctgtaattaagatgacccattctcttgtaccatagatcaaaaatatcgacttcacttctgagagccatttgagttggatgattcatccttaatagaaaatttctgttcttctccatatttattttggcaaccagacattatttttacggtctaatattttgcaagaaaaatcctcaaaataaagtgcgtacccgtgttctagaatctgcccaatacttagcaaatttttctttaaatcgggtacaagcaagacatcttttataaattttggatcgtctgctgtttgaacagcaactgtacctttgccttcactttgggctatagagccattacccatgtgaatctttgcatgatacgatgagtccatttctcgaaataaatttggatcaactgccatgtggtttgtaaaaccactgtcaataacccaaacatcatccttttcttcttgagcagtatggcaagagaaaaccatttcttcagatttttccttttcttctgaaaaattagcccgattaatttctcgggttctgcaatattttgcaatatgactctttctttttcacttattgcatgtcattttcttccggcacatatctgtagtatgactagatttttggcaaatgtcacaccacaaatttgaattggacgtacctttttctcttctctcttgaccatcttccttctgcatgttcagcttggaaaaaccgttttttctgaaaaccacggtctcgcattggaaatccatttttctgaaaattcccgcgaaacctttgagatctgaagctcaactttgactgaaatgcattttcaacggagctcccttcacatggaagctttctttcttcatgagattacaacaagctcattagttgttgaattgtgagagttgacagatctttggactcctcaatagcagccacaatgtactcatatttttcaggtagactgattaaaattttctccacgaccttttggtcgtttatatcttcaccatagaggcgcatctaattaacgatctcaataactcttgagaaatagtcttttaccttctctgactccttcatttgcaaattctgaaattgccttctcaaagtttgaagcttcactgcaagtaccttctgagatccttaaaactcctccttcaacttgtcccatgcttccttagatttcttggcgccaataatacgcggaaatagactttccgcaactccttgttggatcaataacaaggccttggcgtccatcatccgatcctctgccaaagattttttctgttccgccgtaagagtttctccagcaaaatactccctgtaaccattctcaacaatatcccacaatccttaagatagtagcagcgtccgcatcttgatgctccatatatcataattaattttctctaacaaatataggaaccatggactgtgccattgtggcgccctaacttgaagctatacttgtagcttcaattgagaataccgatacgccgcgctactccatcacaccctactcgaacctgggcgctctgataccagttgttggtgttgattattttgctaagaagggaaccaagacgaggagcagagaagcttgtgcttgttttaagtgtttcttttacttgctttgcttgagggctgaacagtacacttggttgtacgttgggcagcacatcatcaggcacatacacaagcattggctgcctatttataggcttacaaccaacgttacttgaagcttcatgaacctagtagaattagtactactggctgcctagtattactgcacattgatggatagaactacactaatctagaacctttttttttttgaccggggcactaatctagaaccttttactgagtagtagtagcactggtcttttgaccataggttctagagtaattgagaagaataagatgtctagaaaattcaggaaatggattaacatcaacaccctcggcgttccacccccgccgtgccctgtcgatcatccgctctagcaccggcgcagcgacgaagggatgcgccgcgatcttcttcccgtctgacgtgacgagctgcacgtcggccaccaccgccggccggagcgcgtccagatcaacaaattctcctcgctcacgatcaacaacaattcaataggctggttaaccaagaaagaagaggaggggagtgggatgacacgtgggccccaccattttatattattatttgtgtgtagctggcatgtgggcccacggattatattatttttcggatcaaaatgctacgtaagcgctatgtcaatgctatgtgggacgaagaactagtcaaaacagccatgtaagcgccatgtcagccaaaaccgccttccaaacgtcgagggacctcgtttgcaccggttttgatacttcagggaccggttgtgtcgacggggatacccgtagaccggatatagagggtattggagtacgctggtacgaggatctacatagtacgacatcaagcaaacaggaaaaaaggattatactggttcatgccccttgataggtaatagccctaatccagttgatatgggattatataatagaaaccacagattacaaagggaatagcagaactcgatgataccgacgagaccgtagtcgagttggttcgactagatcatcccggcgacttagctcctgtaggctccgacttcataggctgtggtggttgtattggctgtgacattcgattccttaggtcctcccggggggtcccttttataccgcgggtcagttggtctccaagtagaactcgaagacatcggaccccacacgatacagtaacgacccagttttgtccgagtaggactccttccatccgtagactctatttctgttacgtgatgaatttccttaacgtatacaagaaacatccgtatacgcgcaggtataccatatcagtatacaacgtatatccaagggtagagggtatatccaatccgtaaccctgacagtagcccccgacttctgcttaaatgaactcatgtaaccgatcgcgacttctgatgtcggggtcgttgtcgttgtcaactggtcgatctcggtgtgagaaccgtagagacaaggagtaatcaacaacaccatgtgaagttcaacggtcatgagtgaatttaaattaaagtccgaaaactgttgcgcttaacggacccagaaatttccggcggccatctctctcctttccttggaattcgcaccgtcggtagtgcgtttatttaagggagttttggggatccattttgaagtctgcttgctgcagaaaactttctaacctccaagcgctcctcgtcttctccactcccgcaaaaaaccctagcttgctcatctcagtcccttctccggtgatctccagcggcaatggatctcgacaagtccacttctgccagcgcgtccctaaagaagctgcaggaggacggtactctccctggttgcgggaccatggagagagaaccaggaggtattgaacccaaacctgtcctaggccgcatggttgcggttgaggattatattctttgcggttttcttcccccgccctccgagtttcttcttctcgtcttgaatttctacagcctttccttgctccatctgaaccccaattccatcgccttcctcagtattttctcgtatctttgtgaggcctacattggggtagagccgtttcttgatctcttccgcttctactatgagttgcgctagatggaacctaaaaaggtgtccggatgtgtcggtttccgacttcgagatggcctgaagtcgcgatacatccccttctagtgcccctcttctcgtagcaaatggcgggcgaggtggttctatcttcagatagaaaattcggatccagtctttgttgttcctgagaagcaaccagacaagatcccagaatggaccgccaagcccaccctaactccctcccttcagtctttcatcgatatcatcgatgacctccgagtacgagggttgtcgggatatgaagtcgctgccgacttcatcggtaggtggatccaaccgctccaggcccgagtccacccagcctttgacaattctgggccggaggacgcgacccggatttctcctcggggtatttttcttgtatttcagatttcattcttcatgtgcatgttcctccggacttatcgagttctggttctcgatcctacaggtttaaacagcgaaactgtggagcgccgcgttggtcaggtgatgatcagcagccctacgacggcgagcaacgtccccgtccccctttgcgagaaggggaaggccgatcgtgaggctgcgatcaatgtgagtgtatttgaggactcctttacttctgcttctctgggatcgcattgtgacttcatgtatgcaggctcttcctctgaccgacgtcatcgggccgctcgcggaccaccaggcggcggcgtcgttaaaggagggcgtcgccaaggaggcatccgacattgctgctgctgctgccacgacgagtggcaccaacgttccgaagagagggaggaagttctccgccgtgctcgggactcgtcggaaggcgcccattgtcacatcctgattttcgtttcaggatttataaattatttaataaattatttatagaatttatattaaatgttcattaatttacaagtgaagttaaatgtgggaaataaaattttctaaatataaagaatggttggatttattttttattaaattctccatgattaattatactctctggaattttctcggatttttcagagctcaattcttaattttaataatacaaagaacagtttagcaattatttaaataataaattaatctttaaatgatctggatattattatgttaaatactttgagtgtccaagtatgttcaagatttttcttggaattatttgagcattggaagtatttttaacaattgaaagatcatctcattggttaatttatttggaaaagtaataaaagtcgtcctcatcagcttgggccgaattcagcccattctctcctattctctctcccttcctctcagcccgcagagaagtctgtttgacctccctggtgctacagtgctccttcttccagctcaggcagagcccgagctctccagcccgtgcacagtgccgccgcctcctcccaccaatccgacctccccgttgctcctatttccaaattagttgcgggaatggaatcctctcaatctcctcttccttttccccaagaaatcctcaaaagtttctatggaaatcctttccaatttcgcggttcaatcttacctttttccggcgagaaccctagactttcccgagtttttcccgtcgttgtgggctcgatcccggcctcccatggctatatatagagccccctccttcccctctttctgccgccacctctccctctctccgccgtcgccggaaacactcttcccgcgactccctctctctccacctccggccgccgctccagccgccgtgcgccgtcgccccggccgtcgccggtcagcgccgccacttccctcggctccgcaaagtcgagctctaccccggctattggttcctttgtgccaaaaaccgccggaagccgcttgccgacgcgaaccagaaggtttcggccattgccgagcttccagccgcagctagcagccgccttagctgccgctttcggtcgccgtcgactctattgggttctcaggagcatggtgaagcccggccactggtttttcttcgccgaagatcgctgaaacgtcgccgccatcgctgacccgaccccgtcgccgcctctacctcgctgccggccgtctgccgtcatcatccatcgtcgcgccgcccctcagtgagctttcctctctccgatgtcgttcatcggtgtggtttatccatagggttttaatccaatctaatctaatttggccctaatgtcgtcatcgtcttcatgtgttgtcgccagaaaatcgtcgccgcagtggatagtacctcgccgcccttcgaagctcgtcgccggccatcttccgtcgctgtccgtcgtcgcgtaagtgttggtaagaatcgacgtcgccttctctacctcccggtgccctccgtttgcattattgtgccgtggttcgccgacaaccgccgctcctatgcctttcacctgtgagcttttccttaatccaatctaacctaatccgctgtctgtctagcgtagtcgtcgtctccgtgtgttgccgccgggtagccattgtcatctctccctctccgatcattttggttcggtgacacttctattcgtgttccctcggtttagtttttaatctctcgtttgtgtcgtcgagtagccgctgcctagccgagccaagtcgccctagtgccgccgtgtcgcagctgtgtgccgctttaacctagccgccgctttaaccgtttgtccgtagtcaagttgtctagccgtaggtgcatccctaaattcctaccggcatatcgtttgccgtaccagggctttaccgtgaatagtgtctagcttaccggtttagccgtagccgttgttgagtcgttcgctcgttcgtttcaacgaggtgtccccggtgcttcgtttgttcgtccgtgtggagtcgtcctttagtttagagccgttcagagccgccggttccgttcgccggtttcggttgatcatttgggtgatcccgtgtcacgtagaattgactcgttaagtcggtatctcatgaggctcgcttgccagatcaatctaatccgttgaatcttggtcaactctcggtcaagattaatctcagccgtcaaaaattgatataaatccgttctctcttttcagtggcatattatttctttttaatatatgtcatccaccaaatatgatctaatctttttcggaggttgttttaatcttttgtctcagttataaatcatttgtaaatggtttaactaatttggaatagtcttttctttaataggtttaattggaattagatcttgtaaaatttgtaattaattcatatgaaatcggaatgagaccgttcaggtctctaaatttatctaaaatcatgatctacatgtttgtttactttatatgtattgtttatttggttttattagtctttttcctcattttgcgtgttagcttgtcgtttctgtcgtttcgaaggatcgtgagtgcgtcggaagtgttcaagaagattaattgaagaccgattattgcaaggcaaatcatacagatcccaaacacgattcctttgagcatgttgatcatatatttaaattctctatttatttcaactgcgcatttatttttgaatgtcactgggtggtgtgaacttattcctttgttatgaccaatttgcattgattaccctatttcttgattaccttgggttattataatttgactagttgagctttatatattggttcagctagatgttagacataattgcttagccatgcttagaaacattagcacaccattgggataactaatgtttcactattacttaatggtgatatttaatgatagctcacgatggttaatcgttattggttaattaattaatttgctaactaaaacttgataatggtgggttgtgagcacatggttttgatagtcgtgctcatgacaattaaggaccggttcacgagtttcggttgtgaaacattaaccgtgccaaccaaaagccagagtgggcaacggctggacactttgtataacaaggctcattgcagagcaccagactgagaagtggcggagataagcccacgggggtcgctggggagtccatgcctctggtttttgagggggtgactatgatccaggaaaggtgcgctgctttgagttgagttatgcgaggggtcttgtcacaactacacaaatggtgacatgttcagcatgggcacatgatgatatggtgacatgacggtgggttgtgtctcgtgggtacagtggtacacctctagcgagagtaaaactattcgaatagccgtgcccgcggttatgggcgggtcgaacaatgtttttcgtgattagtcccacactactcattaataataatgtggtaattgatggtaattaatttagctcctggtttggaatggtatattcctggtttggagatagtaatgtgatgccgggtatggttgttcaggatggttgggcctgtgcagcatgggtatgttgttctgtgttgattaatattgatgattaattactctactgttttacaactctcaattgtttgctaaatgctgcttttgcaaatgagccctatattatgccatcatttggtatccttgtgcacttgcatatttgctgtgtggcttgctgagtatgtcatatgctcaccttgcaataatcaatcaaacctcagttgaagacaagttgcgaaggagaagacgtttggcttataccccagttgagctgcctgtgggagtggagctgaagccgtcgctagacgttaattccgctgcagttttcttttcttttgtaagtatgtaacgttgtattattgatgattctgtatattaaattgtcagtttgtgtacctcggctgattcctggatgacgatttaatgcacaaataagttcggaaattactagtgaatttctgggcgtgacacctaccccatcggtaagcctctcttgtcctttaacgcgtagtcggaaaatcttgacctcacaccatgcttatcttacttaggcctcaaacgcgtctcccccgcctcagcgacggcaaaggcttgtgatgcttggcgaaaagtaagtagatgaatttgaggtcttccaatttacaaaactttggtagcctgactttatgaaaatcacggggcggcgcgggcgaaggcggcgcaagatgggtctggagcagcctctagtgcgtctcctgcagcagcctcgacagatgttgtggtcgtgcccagggactgggaggcgatgcccagcggccctgccggtggccttgtgcctgctcggggcccacccgctgacgtcctcacctggggggagctccaagctgagatggagcgcatcctccaggccggcgctcgcagcataggacgcgagatcgaggaggccaaggctgcggcggcggcgtcggcgaatgaacgcgccgacaagctagcacatgacctggtggaggtccgcgaggacttccagaaaatgagggagctggtggccgaaaacgagaggcagcggcaggggcttgagcaccgcatgtcggagctcgagaacaacttgttggagatccgtggctcgctgcgagtcacctacactggcatgcaccagctcgccggggagtgcggcgtcacgaccaccatcccggcgaaccccgatgagttctcactgacgtcttcactcgcggaactagccacggcgatggaggagatcccctccaagcatgcggccaggatcggggacgagacgtccaacgggatctacacctgggcatgccacgtcctcgcgtgcgtaaggttggcgcaccctgatctcgacctcctgaggatcttggatcagggggctgctaatgacgcgtgtaagggcatgatggaagaagtcagtgacttgggggagtctgttctccccctttttgaagggtaggatttcagtccccttgtactccttaatcaattgtgcttgtaaaactttcgtaggttcaaactgtctttgtgtgtgcagtcatcaccttcgctttctttagcatattgatcccgagtactttgttgtcgttgtagagatgtcgatgtcgatgtcgaggatgtccagcagcgcgggcagcctgagtcgccggtagtcgttccggcacttgcgctcaagccgtatgtgccgcgggacgacgttgatcaaaacttgtccgtggaggcgggcatggcgacgacttccttaggttggtactttggtcctcatctcctttgctctttttgttcggatcgacttaatttgccgtgttctcggaagaggggaacgacttgacttagtcatttccatattgagcagacctcgagagtgcattggccgaccgagatcatcgaatccaatattggaggacgaaattcgaggtggccgaactcgagaggactatggtgcaagtcaaaaaggaccaagccgtggaagcactacgaggtcgcgaggtgtggttcgactcgtaccttaggagctgttatacggccatggccggagtctgtagggatctccgagtacctcgcgggaatcccgagtcggcggccgaatacatctcgtggttgaatggggcctgctctcagcttgaaggcatcggcaagtgtatcgacgaggccctgaagcaggagtgtcgtcgatcgagccgatatgctggagggcacgtgctagcctgtatccgagatcactgcccgcagctacacctcgagttcctccacgaagggttttcacattctcggaggactcccgcagagagagatgatctggcgaagtcgatggcgccgcttgcagagaaagtcttccagtccctggactggcgttggccttcctggtagtctttatatcctgtgacaaatatctcaaggagacatgtaatatattttggaatatttacgaattgtaagaagtacttgtgaaatagaaaagaaatctatctaactaagttttcttactctggatgcgttgtgtatgagtgttttctcacttcgcgacttcgattagtcacttgagtcatacactctccctagcccccagccttgtcatcggagaattgttctcggaagataaggctcttggacctttgacctgcctcggttgaacaagcactgatcctagcccccagccgtgaagttggaaaacccaatttccgattacacggcttggttaatacgcacggcgagaactcttacacgaccaaatcttacatggtcttttgtctcttcatgatccgacaaggccttatctgctctgggcgtccccagccgaagttcccttaggttcctcggaggccttgtcaagacggcgtaaagggacctgaggataggtttcaacgctaggtgtcatcgtggtaagggatcgtcaggaaggaacactttgattgtgatctttacctgaaaacaaactttattgaagctgtaagatgttttacaagtatggatactattgatttatacatagaatttacgtaattgatcaatgttccaagaatttgctaactcgcgaccatcgccgtctgcaatcttgaatgcacctggccacaagacttgcgtgatcgtgtacggtccttcccacttgggtgagagcttgttacgccctgcttggctttgaacccgtcgaaggacgtagtcgccgatcgaaagtgtgcgtgctctgatgcgcttctcgtggtatcggcaaagggcctgttggtagcgggctgctctgacgacgactctttctcgatgttccttgagtagatttacgtcgtcgtttcgccgctcctcctggtcctcgtcggagtacttctatactcgtgtactctgatgtcgtatctcagtggggagcatagcctttgagccgtacacgaggaagaagggtgtctccttgttggaagttgtcggtctggtatgcatggcccatagtacagaggggagttcttcaacccacttcttgtcatgtgatatcagtctgtcatagacacgggtcttgattccttgtagtactatgccgtttgccctctcgacctatccattgctctgagggtgagaaaccgaagcgaagcagatcttgactcccagcccaatgcaataatctttgaagtcggcactaatgaactgggagccgttgtccgttatgatgcagtgaggcaatccatatctgcagaatatccctttaatgaatttgatggcgttgtcggccttgatttcccccgtgggtgtagcttcaatccacttggtgaatttgtcgaacgccacgaataggaatttgtggccgccctgtcctcatgggaatggtccgagtatgtcgagcccccagcacgagaacggccaagtaagagggatagtctggagcgcttgcgctggtagctttgtgtgtttactacgaaattgacaggcttcacaccgttgtaccatgtcgcaagcatctttgagtgcagtcggctagaaaaacccttgttgaaaagctttttttgaccaatgtgcgaccggcggcgtgtgacccacagatcccttcgtgtatgtcgagtaggagatgtttgccgtcgtcggacgagacgcatttgagaagtaccccgtttggcgccttcttgtatagatcattgccgatcatatagtagattttggcttgacgggttattttctcggcctctgtatcgtcctcgggcaacttatcgctacctaggaatttaatgagtgggatccgccagtcgtctgtggtttctatgtcggcaacggcgcgttctgcatctgtagcccccgagctaatgtcggggactaccacgctatcttcatcgtttgcctctttcaccgatggctttgtcaggacgtccaggaaggtgccgggttcgagtggctctcgtttagacgcacgccgtgtcaggtcgtctggttcgatgttgtccttgcggtatgtgtgccggacctcgattccatcaaaccttttttccagcttcctgacttctgcgaggtacttagataactcggggctagagcacttgtagtctttgtgcacctggtttgcgactagttcggaatcctctttcacgatcagtcgcttgactccaagtgaggctgctgctcttatcctagcgagtagtccttcgcattcggctgtgttgttggtcgccctgaagttgaggtgaattgcatgcttgaactgatctcccgaaggtgatgtcaagatgaaccctgcccctgctccttcactgttgagtgcgccgtcgaacgccattgtccatgtttcgctgtcggtttgactgtccgacctgttttcgggcatagtccagtcagctacgaaatcagcggggacttgggacttgatggctgttcgtggcacaaagtggacatcaaactggcttagctcgactacccatttcggaatgcggccgacaacgtccttgtttctcacgacttcaccaagtgggaaggaggaaacaactgtgactctgtgggcttgaaagtagtggcgcaacatcttgatgtcatgattactgcatagagcagcttttagatctgtgtgtatcttgtctttgcatcgtggagagcttcgctgacgtaataaactggtctttgcaccttctctctctcgacaacaatgatggtactcacagaatatggcatggtggcgatatagaggaataattcttcattagattgggtagcaacaagtagagggggatttgacaggtagcgcttgagtgcgatgaacgcctcttcggcttcctgtgtctatacaaatttgtcttgtttcttcagcagagcgaagaaaggttgtcctcgttctcccatcctagcgacgaacctgctcagtgccgccatgcatccagttagcttctggacttccttgagtcttgtgggcgacttcatgttctcgattgccttgattttctcgggatttgcttcgatccctcgtccaaagacaaggaacccgagcaacttgcccgatggtactccgaacgtgcacttctctggattgagcatgaggcgatatcgtcggaggttgtcgaacgtttcccggagatggtccatcaatgagtcgcttgtcttggtcttgacaacaatgtcatcggcgtaggcctcgatattgttcccaagctgatcgttaagtgccccttggaccgtgcgttggaaagtgtttcctgcggttatcagtccaaatggcatcttaacataacagaatacaccgaacggcgtgatgaatactgtcttctcctcgtcctctttcgccatgctgatctggtggtagctggagtaggcgtcaagaaagcttaacaactcacaaccagctgctgagtccaccaattggtctattcaaggaagagggaagtgattcttgggacacgccttgttaaggtcggtgaagtcgacacacatcctccacttcccgttggccagtatcgcctggcatccgttgttcgcgatcatcgcgttcgtgacggctgtggcggttatcacggtctcggttctcgctcgggtgccctcctcgctcttcgttttctcgacgtcgtgaagagacgcgatgtcgggaacgatttttgttgtctcgcgcatgtcgtgcttctcggcggccattcaaatggtcacggagatcactggtgccgtgaggtggaggagtggcttgtcgaggtgatgtccgctgctcaggtggttcgccattggcaacgccagctggcggttgttctggctgtgctccggcagcggcctcctcgaacgcgttactgagattagccactgactcccgtagtcgttctgtccaccgtgcgagatcatcgttcagaacgggatcataaggggtttccctcggtattgcgttgatggcctcgatgtgctgggccggtgtagccacttgattctccgcttctgcgttagcgcgtgtagacgtgctagtcccaccgatagcaaacacatcacgtggtgtactcgtcaacgatgagccctggtcttcgagcaagtgtagaacttacggctcatggggatcgatgtcgattaccccaacgaatcggtctgagataactgtcaccccttcttccttgtccgcgcatctaagagggattggcaggcacgaatctcagcttgtacatcgagaaaaacccagcaagcttgcaaggtgtgtttcctggttttgtggatagaacaccaagaccttgtcgcctcggaagttgtccttgccggctcgtgattctcgtcggaaggacaagatttggccgcacaaggatccttctcaggctcggatgtcgtcgatgttccgttctccacttctgcgggaggatccttcgacatggagtcgcccagggttgtaaccacggcattctcgcttccggtcattgatggaccagtcgagatcgacaccgtggtgtaaaccgggaagacgatttcgccgacttgagtccacaccagcattgttgaagtagaaactccttggcttgtgccggggttgacgctgttgtcgacgaagcttgattacatagtagtagaaccttgagcaccaagtccccctacctggcgcgccacagtcgacgggggatacccgtaaaccggatatagagggtattggggtacgctggtacgaggatctacgtagtacgacatcaagcaaacaggaaacaaggattatactggttcaggccccttgataggtaatagcccttatctagttgatatgggattatataatggaaaccaaagattacaaagggaatagcagaactcgataataccgacgagactgtagtcgagttggttcgactagatcaccccggcgacttggctcctgtaggctccgacttcgtaggctgtggtggttgtattggctgtgagattcgattccttaggtcctctcgggggttccttttattccgcgggtcagttggtctccaagtagaactcggaggcatcggaccccacacgatacagtaacgacccagttctgtccgagtaggactccttccatccgtagactctgtttctgctacgtgatgaatttccttaacgtataccggaaacatccttatacgcgcaggtataccacatcagtatacaacgtatatccaagggtagagggtataccctatccgtaaccctgacaggttgtacctggttttgtggttcaaggacgaaaatcgaattcggtgtagagtcaagggacgttagatgaacttattcctacttaaaataaaccggtttctagtggaaaaagtacaccgaaggtctctcaacttgtcatcgaattacaaactcgtaccctaaccgtcaaaccggatacaacgcatccctcaacttacaaaactcatgcaaacaagctccctcagcagtttagactccggttttttccgacctggcagctgtctcaccgtgagacccacatgggccccacacgtcagggtgtccacgtcagcacctactctctttttcccctcttctctttctctcgctctgttctcgcatggggacggcgctagggccgccgcccacaacggcgcgcgcggtcgaagggtggtgcggccggcggctcccgggtggcagcgcgttggctcagggtggcgcgagctcgccggcctccccgctcccctcgtgcgggctggccgacggggcgaggcaggaaacaggcggtggggtggcgtggcgacgcggtggcgatgggcgcggaggtggaagcaggcgcgggcggcggccggttgcggagcagctgggcgcggtcgaagatgttcggcgccgccagcgctttcgccagatccaatcgtcagttcatgcaacgagagacgcatcttcagctaacaactgtattgcagttcaagtattaaaccatgaagaatatatgctcaaattaaaaggcattgcatttgtgcttacatggcttggggatgtgctcctcgaggtcgccgcggacggagcgctcgacggtgactagcgactgcagcgcgacgatggtcagggagtccttggcctccacgcatgacatgcggcgcatgtccccgactttgcgggctgccacggtggcgccgcccctcccatctgtcgctctcgtcgtgccggggccttccacgccggcgtcggcgtggtcgccattgcgcccaaccttggtcgtcgttgtgccttgcatccctccgcttctgcttggtgcgacaaatgactgaaacacactcgattccctgtgagagcttgtggtcttgagaaatctatgagatcgtactggtcttgagctcgctgctcgccgtcgccgagagcggcttcaggggaaacccaccgaaacgaaccaccctcctcctcacccttcgccaccgatggcggagcgcgagggcacgccggcttcccaccccgtgtcggccgtggcgccgcctcccctcgccgccctctctccctctctccgtttgcttcctcttctcctgttgttgaagtcgtgtgcgttctgtgcctgcagggtgcccgcggcggagggagaaagcggaaaggcacggcggccggaccgcaacctccgcgctggggcagcgctgcgcgcgcgcggcgtcgctcagacacgtggacacgctccgggagctcgggcactgcctgtagaagggctacggcgtgcgctgctccatgctagacggccgccgcctcctcatccagaccaacgcccgcgagatcgcgccgcggtcaccgcgtcggcctcgctcctccgcgccaccagcaagctggctacctcctgcgcggcactcttgcctcttctgtgacttcggctgccatgccgcggccaaggcacccagctgctcccccgtcgccacccgtggagaggagacggggatgagaagaggtggagaggggagaggaatcagaggctgacgtgtggggccgcgtgggtctgacgctgagtcagctgccacgtcgaacaaaaccggagtcaaacctaaaccgctgagggatctagtttacactggttttataagttgggggatgcgttgtatctggttttgtggtttggggacgatgttgtaactcgatgacaagttgagggaccttcggtgtacttttttcttttctagttcctggttctaattcagaggtaggtttagctgccctagtaaggcttagaaacgtatgggctgggacgacccaaataaggcccaactagaatgaaagcaaaagagacgcaaagccacctgaagccggccattccttccgcgtttccgtcgacgttccgccgccgacacaaacgctttgatgccttggcacggtgggccggccctgcactgcacggcacggtcaaagaaaaatagtagagggatgcaaaatagattcaatcagccatataatacatggctaaggtagaagagaaatataaaatagacttatttccagtcatataagctcaaaaagttaatggatgaaaaatagacttattctatggagaagcacaataagctatcatgtcttcgggctgacacgacccaaatcttattgggccgtgtgcgcagcccatgggctagcccggcacagcccgacatgtagatcgggtcgtgccgacccaattgaccttggcccaaggccgagtcgtgtctaggccctgacgtgctggacgggccgtttggctatctatagctgtgccgtccaccacaccgcgttgtcaatttaaagttggattcaaaataaacatatgagatatgttcacattgtagagtaaaagtttcaaatttaactacgactaaaaattttactctcaatgaaaaaagtttattcttaatacagtaaacatatctcaaacatccaattctatattcaacgatagtttcaagactttcaccgtatatttttcaatgttgtacagtgtccactatccagtcaaaagccccatctttatgaagtcatctacctctcctgtctcgtctcaatcccctccaccaccacgcgcgcacgaaacccgcgcactttcccctcctcttcccttcctcgcgccgcgtccaaccgcatcgcatctcaccccacctcctccctcgggttcttggtgcggggagccatggcggccgccgccggggcgccaccggggttcttctccttcctcaagcacggcgtgctcgtcccggcgcgtggccgcggcgtgttcctgccgctgctcgcgctcaccgcggcgctcgcgggcgcgctcctcctcgcgaactcgctcgccgtgcagccgcgcgccgtcgccgcgctcctcgacgccgacgccctcagccgcgccgacccggccagcgccgcgtacccgaagctcgtccggaggttccgcgacgacctgcgggggctcctcgtcgacgccgccgcgtgcgtcgccgccgcggtggtcgccgggtcggcgatcaagatcgccaccgtgttcggcgccgtcgcggcgttctcccccgccggcggcgaggaccgccgcgccaccgtgtccgggctcatcggcgcggcgagggggaacgtgtgggggcccgtgctgaccatcgccttcgggtacgtcctcgaggtggtctgcgccgcggccatcgtcgccatggcgatgctcgtggtgcccctcctcgagtactccctgctgctcctcttcctcgacgccatggccgtgctcctcgcctcgctcttcctcgtctacctcaccgtcgtctgcgcggtggcgctcgccgtgtcggccgcggagcccggggggcgcggcgccggggcggtgtcgcgcgcgtggcgcctcatgagcggcaagaacgcgcaggccgtgctctacgtcgtcgccacgttcgcgctcgccgccgcggtctcgccggtgtacacgctcgcgctcaggtggtggcctcgcagcgcgccggccggcatcgccgccggcgtcgcgtacgtgctcctcctcggcgccgtcgaggtgttctccgtcgccgccgtcacggcgtactacttcgagtgcagggagatgaagcaggtggaagaagacatggcggcgggtcaccaccactacaccaagctctctaatggcgacgaggcaaacatttgaccaaacatttgtgaatttttctctcttccgaattcattgtatgagtagtgtttgatagatgctactactaatattcttacattgggattgacattgcaaattccatacaaaccttcaagcaaggaacagtagtaccatagcaatatcatgttacatctatgcctacattttagtgtggtgaattttgctcaaattgactgtaaattttgtgattgcacatgtgaaaactgcaatcttttaaaaattatgcgaattctaaaacatattgaaagatgatgcaaattctcataattagggggttcctgatcaccatcatccatctaagttatcacagcgattgattgtgttagttgggaacaaacaatccctttaccagtgattctttcagcccaatatattatttaaacaaaaaaatatgagatcagaactaagcaagttgctgccacatccctatcacacattaaatccacccgaacaatctaagcaagtacaggtaaaatccatcacaaaaatggagaaaaatatctctgcgaaaacaactatgcatatgctctgattcttctctcaggaaggagccaggaatatgccaatcttattggcaccaagaaagcatacaattctctgctgtgcttttgaatccatcgaaagaaaaaataaataaattcagcatgtagttttcagagagaccgtcaaattaaggcagctaagctcgccatcgccacacggatttcttctcgtggagaaacggatgattccactatgcgtcgctgtcagctgcggcgactgatcgttggacacaattctggactccgtttgtccaatcggatcgcaacggtgactgggttatgactagcttgataacccatggtcgactgctttcccatggaattcggccggggaagacagtgacctcgccggagctgggggtgagctccagccaaagaggtcgacggcgttacgctggcttgaaatcgcgaggccgagatggggtccagaagaagattgtagaacagaaagattttgaatagttttttagaaactcaataaagaatttgtagttttagtagtgatgggcacattgttgtgtcatgtgctgatccaacatgtttaagctaataatgcagctgttttcttgatgaaattgttcacgtggaagggagagatgatgaccattgactccaacccaatcatgccttgaaggctcatgcaccacaatatagtgcacatgtatgtaatcacttatataaaaaagaagtatttgagtcagatggggaggaatgccagcagggaaaaatcacatgcccatgatgtactgttggtcccaatcaatcacacatgaagggcccaagtgaaacatacattcgatagttgcagtaggataaaattaaagtacacacattcgaaacggggctttacattgttgccttgaagccaaccagggcaatttttatacaaaccttaggtcaactttgcgcatgagttcatgtcagatagattacaagtcctccaatccctattgtcttatatggcatgtattaaaaaaatacgatacaattattgaaatttacagtgtaaacttaagtaatttatggtgtaaaaattattcgactaattttaaacgaaaatctgtaatagagaagtccctttattctttgttttttttgttttgttatcctcccaaggtacagtctaaaaaagttttacaaacttccttgggtcgtcggctctcgatgctggacgccctcctcccgtgagcaactgagcatcgccagccactacggcgcactataacatacaggccgtgtttagtatttttggcaaaaaaaaaattgacgtatatggacacccatttgaagtaacaaacgtgaattaataacaaaacaaattacagattctgcctgtaaactacgagaagaatctattaaacctaattaatccgtgattagcaaatgtttactgtagcaccacattgtcaaatcatggcgtaaataggctcaaaagattcgtctcacaatttgtaattggttttttttcgtccacatttaatgcttcatgcatatgtctaatattgatgtgacgaaaaagttgaagtttgaagggaactaaacacagctaggggtggacgttcggtcggaccgaaaaattcggtctcggtcttcggtttttcggtcagttcggtctttgcaaagtcaggaccaaatttctccaaaaaaactctggaccggcaaattcggtctcggtctgaccgaaatttttgagaataaagtttggaacgaaaaaatttgacataggcatctccggcgctgtggagggcggaggcttcggccgctgcgcggtggangacccggctgcggccgcgcggtggagggtggaggcggcggccgcgtgggggagggtggaggcggcggccgcgtggtggagggcggagccggcggcaacggcgcggtggaggctggaggaggcggtggcgcggtgggggcggagccggtggcggcggcgcgggaggggctggaggagtgcggcagacggcagtggtggtagactggtagggttgtatcacttctagggtatgttttagtaggcttattgggcttcctaggcctattgggccaaaatttcggttaattcggttaaccgagcccaataaccgaaatgaccgaaataaattcggtcttttgaggactagaaccaaacagataaccgaatatctcggtctcggtctcggtcttttcagttcggtctaaatatgcccacccctaaacacagccataggcttacaacctttgaggccaaccaatgaaccgtcactcacttgacagttatatgattgtagaagatgatccataattacttctatcatgtttatctatatctattctactatataaaagtatagccgtgctcgttgtctctcacaatgtattaaaaaaaatcgaaatgctgtgctccggaaagtaaaatcactaaagaaaaatggagggggggggatgtggttggataaaaaattatccgttttttatgttagatgtacatcacagttttttttttcaaggaaccgatgacaggagtttctcctgtcggaatttatagaagaagagcccatttttaatagtatggctcgttgcaatgaacgatcatatattacaaggtagaagttggaagagttgcattctaacacaaaaccgggtatggctcaagttttattcactggttctcaatcatgaaaccggataaagagagttctataattatcaaaaccaatctaaagtagtattgtggatggtcttggctaacgacctaatgtggcatcatagtcgaaaaaaaacacattcggacccgcatataagtggtcacctcaccttctgtttctatcttcccctctttctcttcatcctcttattcgaggcatttaactactcttcatctcgaggcatttgaacaaacatcccttcatatatattttataatcatttaaaaaaacaagaacaaatcatcaacatgtaaaatttaaataagtttatatatttaattcttcaaaatcttaatgataaatttcaagttgacaaataataactccataaaaaaataatctatataaacacatgatagcctagactcacgagccacctcggccttggctcgtttggcttacaagccaagcaaaccaagctcgagccaagcctgagctttttttccacccggggggggggggggtggggttgaaatagaatggggttatggatgtggatatggaactgatgtcaatttggatattgccaatgtgaatgaatgtgtgtatgttgacgaatggacgtggaattgaatagagtttggatgaataatgatgtggctgtatgttcatgaagtggctgtatattggcgaatggatgcgaatttctgttattgtgtgatttgtatgtgaaattggtaggtcctaccatttttatttggttttcctgccaagatataggtaccggtttttttacaaaccgacacctataatctttgccacgtgtcctagctgcctagtcaacaaccggcatcttatatgcttctataggtgccggtagtatttaagaaccgacatatataagatcatccatgtggcaatcgatttaagaatcggcacctatacttctatataggtgtgtcatgggtgtcggttatagatccgacatcgatgatcgaggtcaaacgtaccgccaactaggtgtcggttgggatatccggcacctatgaccggttcccaactgacaccgaagtggttttctgtagtagtgaagcttcatatgctaatgtatcacatatcacaaatatgacaacttcaattttctggtaactttgagtattgaggaattgatatactctcatatttgatctagatctaattaaagctgtgccaaatctttgtgtttttcatatcggcgatcactgaatttgtttatctatagtacctcccattgacccataggtgaacatgtttcctaaaaaaaattactagattcatgcgccctacaattgttcttttaagatctcatataccagcatatatatgcatgcatcactattcgtattttctctttgttttctcgcagaaaaagaaatattttcttagctattgaaaatatgacaatgagatcttaagtcactttagtacatgatgaaaaataatatcatgtttgcttaccatccatggttcttccatttcgtccgcggttcttcgaaataggagaatcttaattggtatcatgtcatttatattcatagcaatacaatacaaaccttgaagaatgttgattcttttaggtaacttgcatgggaaaatatgtggtggaatccacatgtgtagtggaaacttagaaactagcgttagatcaaatgggtggtgtggcataaatggtatatttgaggccacatcaagattcttcataccatttggaccacacgtgtatttgaggccatacggccatactatttaaactttattcatatagactatacataaatactacgtgcatataaactttatacatagaaatttcacacgcataaacttcatacatataaactttgagcatataaatttaaaacgaattaaaaacaacaacttaaaaagcaaaacaaaacgtatgtgtggatcgcgtgcgtactctctcctccttgaactcggtctgctttaagaaaagaaaagtagataggctaagcctaaaacgaaaataactgtaggcccaagaacagaaatttggctgatagcggtgcgcgagctgtcgcgtcgcgcacattagtcttctcgagattgtagatgcatccaattaaccctggttgaaactgttgcttttagtggcagtggagtcgagtcccacgcggcttttcttcaccatccagatctcatgaggaggtccactgctctcatggcggcggcggcggcgcagctcctgctggctgctgctgctgtcgctggcggcgtatgcgtatatgtcggtcatatcgcacagggagacggagacccggcggatgttcgtggagtggaaggccaagtacgacaaggcctacgcctccatcgccgaggaggagtgccggtacgcggtgttcagggagacccgccgcgccgtcgaccagcacaacgccgggttccactcgtaccgcgtcggcctcaacatgtccgccgacctcaccgacgacgatgcccccccccccccccccggggtgcgtactgggagagaaagaagctgagctgatccaacaaggacttgctcgactccatccactgtaggacatcgagcggttttgcaggtaaaacatgctgctttttatttactagtccgttttttatttattatttctttgattaaagaagatgttcattggatacatacaattagcaagtaacaatgtttgtatcaagacatcaagtggggaagatttgtttgactagtatagctgcatgaaaaatgcaggtaagcatgaaccattcaaactgtaattaaggtgttgttgttgctgcttactcctccctcctaaaatataagcatttttagcacagtgataagtcaaacatttttcaactttgactattaatagctataaaataaaaaatcaatcatgtaaaattaatgctactagatttatcattaaacaaactatcataatatgtaactctttttatttaaaactttttacttttattgatattgttagttaaagtagtgtctcggagaccgtgtcagagttcaaaaatagttatattttagaacggatgaagaagtatatattcacccaaagattcacatcgccacatgttcttttagctcacagccatggagggcagaaaagctgctgtgttgcttgatcatttagcttgtgttagcacttggcaatcctacttctgtgggttaacagttaactctctctctctctctctcgtttcatgaatttttcttggccggggcctccaggttcatgaatagtctcacagaaactgaatcatcagttcattaatctaatgtgttcttccgcgcgcggacaaacagggagtgattttaagtcttttggtttggtggatatatacttgatccagtgtttcatgtgaatatgtgattaaggcttaatacgttcataagttattgtttccagtgcattaaagatgaagtgagaggtcactgtaaatctgtaattgagttactgattgattggtaatttttttttcttgcaggagtatgctggcaatgtgataccaagatgccttctgtgcgggttttatgttcaagtacgttctcctgctggatctcctcgaaattcacctagcaaaatgtcaagacatacaagtgcaggggatcaggtcccaagggcagatatgcatatgctactgtaatatttgcgcaaaatcagaagggatcagtgatatctcacaattcttcaataaatatggcaatagttattgtcaccgatccgattgatttgtactagttcgatcatagttctgttgctacaatattgtgatcctgttatttcggtctcgagggctgcgtatatatggccggacgatctccgatgggctgcttagttgggcgcttgggcttcagctgcgcatggccgcatgtcatggcaaggcagcatgcctatcgggcccgtgatctcgagagtttcaaggatgccatcaaatctctatctctatctctgtcttctcttctcttctctactctctatctctactacttcctccgtacttcctccatttcatattataagactttcttgcattgcccacattcatatatatgctaatgaatctagacatatatgtgtgcatagattcattaacatctatatgaatatggggaatgctagaaagtcttataacgtgacacggagatagcacttaaaaaaaagaggtgtttctgacgtctgtgcaaaaaaaccgggcgaaaaaactgggaaaggaatccgattccatgtaaaaaaaggacgaaaaaaacgaacctgtccgattccaaaaaaagaagaaatcgggcaaaaaaaaaaaccgggcgaaaaaaatcaagtgaaaaagccccggaaaaaaaaagaatccgattccgtggacgcggtaaaaaaggggtgaaaaaaattaaaaaactaaactgtccgattcaaaaaacaggaattatatgtgacgtggtaaaaaaaaccgaatcctattatatgtgacacggtactatatatctctatctctatctctactacttaaaaatttgaaaacatttccgtcgtccgtaataacaaaaaaatggcgaaaaaagcgttaaaacaaaaaaaaagaaagtccgattcaatttacttccgtcatccatgaaaatcttatcttatcttactctcaatctttccgaggggaccgagcggcgccctccgtccccgcccgcgcgatgaaacgccagccaaagcaaaaaaaaaagggaaattgagcaaagagataaactagattgaagttcccaaaattaaaagaggataaacgatattgaaactcctgtaactcgaaaagagggaataaaatagattgaaatttctctacaaaattccgcaaattcgaagaaccctaattttcaggtaagaaccctaagagtcaagatccaaatcaattaagctaagggttcgggttacttaccggacttgaagcccctaagctcaccggagctttccaggaagcggcaccaccgcatcttcacctcctcgcagtcgcgtcggattccccgtgcgcgctgtcctggagcacccctccaccgtcccttgccgaagacgggaagggtcgcaccacccgccaacgaggtccaggccgcttggcgctcgtcgccgtttgtgcgcccgcctagccagaccaccgacgccgtggcacggctttgcgctgcccttgggtgcgccccccagccggcgaagcaggagccgctcggcggttgtcaccgcatgcacacaccagctcgctggaccaccgttgttccgctcgctcgttgccggaaagaaatgggatcgggagagagggatttgggagctagggttttatccctctctcctagtcggcgcttcatctagcgcggggaatcggagccgtccatttgatccgacggctcagatttgcccagcgtcaggcctccaccgccgcggaaagtgcatcagaccgtccccacatatgtgagccacgctcagatgctcggcttgcgggccgttgaattgcctcggctcgccgaagtgggccagcccaagtttgggccggcttgggaagacttgggccgaaagcaaatttgatcaaacaatgtggctcagattttttaaattaaagtccgttggataaactcctaagtaggctcgaaaattaaatctaaaactaaatcttaaatcctatgctaattcatcaaattagactcggttctacctatttgttaatatatcaaattagacttgattttttaccgatttgaggttttcaaggtgtcacactatcaaacggtgtttttcctgttgcaacgcatgggcactattgctagtcaaaattaaaatcaaatatttcattttatttcatttttgttttggcagtggcagcaggccgtttttttgtctgacacgtgggttctatcgtattgtttttcctaactttaagtgctacgtcagcttcatgtcatgcaaaaccggccttaatattgtcctaggactttatgtacaccgcttttggaagttgatatatatataacctgcacaagatagtgcgacgtttctattgatgtagcaggaaaaaatacaagtctatagtcctgggagactatagttaggaaaaagaaaagacagccacatcacgcgtctacgtctgatcctattgctaaaacagaacaagcacacaatacccctaaggaatggatattctaaatgatgcctccaaggaggcgaacgacaccaagagcgccgccgacgcctgtcctagaaccaagactcggttttcacctaaataacccattgggagaggagagaacaaagcaacgccctaaggggaaagcggcgcccgtaggtgtcgccattgccggcccgaaggctaggtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcaaattattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagggggcgacgggcagtcccctctcgtgcctaggtgaatccggaagcgacagaggccgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaactgccatgggtgcgactagcaaaaccatgcacccacagcccaccattcagttgcattttagttggataattacgaccatgaagcatggccagatgtctcgagcacgcagctcaacaagatactagaaaggtctaaaactgtaattatcccatcaactgagctagtggtaattaagcatggctaagcatatagttctagctaggtcacataagtaacatgagctagtcggttcattacccaaggttgccaaagaatagatatcaagtaaacatggcacaagcgagcagataggtaatacccagatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacgggaactacgcgctggcacgcaaaacgaggaaaaactctaataaaaaccaaggaaacagtacataaaaactaaacaaacatgtagagctcaattttagatgaattttgcaagttgaacggctcaattcggagttcgaatgaattagatatgaattttagaagttttgagccatttaaatgaatttctagaattattaatgatttattgcgcaattattatttatttttacaaaggaaaaggacctcgctgacgtcagcaaggggcggccggcgccgacacgcgggccccgcacgtcagcggcacaaaggggcggcgcatggtggaccaagtccacacgtggcctcgggtgcgcgtccaccacatggacggcccagatcggcccgaagccgatcggacggccacgaggcggcgcggctagggcacgggcacggcacaaggccggcctggctgagccatggcgcggcggcggcgcacgagagaaagcggcgacgcggcgcggcaaagggggggggtccgggcggcccaggcgagcggagcggcggcaagccggccggccgacctaacagtggcggcgcacggcccggtggtcgcaggcggcggccaccggcgcggcagcgcgcacgggagacagaggagggaggcatggtgggagaggaggagctcaccaaggacgcggcgacgagggatggggaaaggcggggaagctcggcgtcggcgctcctcggggcgaaggcggaacggcggcccggcggcgttccgcgagcgagaaccggcggacggcggccggagggaccggcgcgaggggaaccgtgttccggcgggatcccggccgtgaaaagcggcggccgaggtgctcctcggcgctgcgaagcgagcggcggcgacggcgcgaattggggtgattaggagcggcgccaagcggcggctggaagtggtaaaggcggtggagagaggtggtgcgcgtggcgacggtgcctcggaagcggggaggggaaaaggagcggatgccggggtagagcttggcatggcgttgccgacgacgcaaacggcgaggtgcggcgacgactaacgcggcagcagcggccggctgaaggcggcggcagcggggaagagaggtggtgctcgaggcggcagtgttccagaggcggagaggggaaatggagtggaggccgggctgcggcacggcgccgcgaagccgacagaggtggcggattggcacggcggtgggtggagcggctgaatcgccggccggagctcgccggaaagcgccggtgcgcgggagcagcgtggggagggcggtagggtggcgcggggagctcgggaaaacggggaaaaaggaagaggagtccacggggattgattttataggttcatggggcgaggagacgtccggggaatggcggattttgagagcaagtgggacggcgttgtgggggagatagagacgcgggaggcggcgacgtggccggattttgcggggagagtggggggaaacggcgcggacgtgggcggcgaggtcccaccaataaacgcgcgcgcgcggggtggaggaggtgggcggaaacggcggcgacgttggacggctcgggcggccatggcggttgctggcccgggctggaggttgggggtgaccccgacaggtggggcccacctgtcggcggctcgggggaaaggagagaggaggagacggttggggggggacgatgacaggtggggcctcgggtcccacctgtcggagagagagggagggagaggccggctggggaggcaaagcagacttgagggagagagagagagccgagcggcgagctgggccgagggagagagagagcccgagaggggaaaggggaggaatttgggccgagcccgaaagcaaggaaggggaaaattattttcttttctttttatttaaattagtttaatgaactttgtgactttaaaactatttctcgagctccgaaaattcacggaaaattccggagagtacattagggcacaaagaatattacaaaatattcccggccaatgatttttaagggaaaattttaattctcccattaattcacttgattaagttgatttaacttttatttaatttctagaaaatgcattatttaatgatttttaatcccgaacgaaaatcggggcgttacactaggctttcgcccatagttcctacacccccgcactgaagagtgcatgtcagattcaacagagccaccagctaatccccttcaacgcgcagccaccgcgccgacgcctcgccgccggccgaccatcaaagtagagtctcaacctccgacgcgcttcaaatccatccacgtagttaggttggagaaagagagagatggtgatcagagagaagaatggatcccctctcccccgcactagcccgtccaacgtggtcatcttccagcggtaagccaccgctgcaagaggacaattgcctggaaagaagttcgtcgcaggcttcgacgcctccctcatggcgctaccgccgtcgccgcctcgaccatgttgcccgtgttcccgcaatgggtcacctagtcgcatcgccgtcgcctccatcctcccaccacgatagccttgctgccgctgcgcaccacccatgccgtgcttgcaccacggcaccatccgcgccgaccttccacggcccctgtcagtcttccaccgccacctcgctgcaccggaggcccccagagcctccgggcacgcctctaatcaccaccgtgcccgcctactaccaccatccgctgctcccagtcggctcctctccatccccgccgccgtctccgcttgcctcccaccgacggcgacgcgggtgtgcgcccaccgtcgacgtcgtcgtcatcgcgcccttctacctccagacgtcgcccccgccacctccacgctgccgcgtctcgctgccgccggctcgagggttggctccccgtgcgacgctcggggaggccgcccttacacctcggacgtccgccgcctccacgccgccacgccctgacaccgttgtctcgaggggatccgggcggaaggcggccggatttgggccatcccaccaccttcacgtccacaccgccaccgaagcccacgtcgccacctccacgcagcctcgccaccgccaccaccggatttggacgggagggtgccggatctggccggcggcgccgcctcgccgtcgtggcgtctcccgtacggtcggagtcgtgggcgtgaactacgcgacctagagggaagaaaagaaggccccaccaccgccgtccttgcggccgcgtggtttccgacggtccgctagggcggcgaagaggcagaggggggagggaggcgtaggggtggacgaaaagctcgtgactcgttagctcgctcgactcgtgatcaagctcgttgtatttttctaacgagccgagctggtattttaactcgttagagataacgagccagcagctcgcgagccaaactgagccaagaagacatcagtcttccagtccaaaatggccatccttctggcccaattaggcccaactatgccatgctacaacggtgcgttcacatgatgtggccatatggggccactggccagcctcacgctcgtagatggggataaaccagtacacgatgacctgaaaagaaagaaaagaaaataaaaaagaatctgagaggagcgaggagcctctctaccgctgattttgccggcctgccgctcgcccgatctgctagtcgcgggcgtcccctgctgccgaagctacgggatgcgatgaccttcagtctgaggctatgggaactggtggcgtcaggctcatgccgccggattcgattgtctcctagaagcacacgaagccatggcggtgagtggaacccagtggccgaagatgcagataaaggtctggcgggaggcagtccccgagaccttcctcgagctctgtccaaccaatcttcgttggacagcgtatctcgctctcaccaccaccatctctcgttggcgccgccgcaaggggtcacgggctcgccacgccaccgccggagcccatcgatgtccggccgctcgtagcagcagtgcaacaccagcaccagaccaacacatgttcttcctagccttctccaagtcgaatcgatcccaactccagcgcctgacaacgccgtcgtgccgccagccacctcctgcattgcttggctcgcgagccaaacgagctagctcgagcttcaaaacgagccgagccgagctagcagtttagctcgttaggataacgagccgagccagctcgttatcctagcgagccaggccgagccgagctagcttgatatccatccctagggaggcggttgtagtggagcggcggctaagggcacctcccgtgtcgtccctgccctaggggcgacgcgggggcaaggatgcaaatacaagaagtagacgtgttatatttgatattgcgttttaaggatataatccaaactcaacgatatctaaagtaatcttatatcgcttttgctattatgcagtcgcctgcaaattagcaatcgatcagtcgatcacgctggccgttgattctgcttcaatatttgtgcgtgttatcgggctagtggggaggctcttttggatatgggccacgcttcctaggccttctttttaattaaaaaaaactaaaaaaattgtgtccgccgcgtgcaccatcgaacagatatgccgatgacttttccccaccaccgctgccccgactcaatctcagaaattactgcggagaaggcaatccatcacctccctctcccgtctccctggtggcgcgattttgtccatcggcggccacgagcggcggcgtcaccttcctctcccatctcgtcgagcggcggcatgaggtcagcgcgactttttctcaggtatttaggcttcatcagccacccatcctcctcccatttgttcttttgctcttgcgcctctgcttctggaacgagggagtggcacaggaagtggcagccacagacaacaagtgacggggcggggaattgtagttttttttcttcgttttgttcggagggttgaggagatcccatcatgcatctacagggcagagagaaatttttgctagggtttggatgattttggatggttacatgtaccactgggattagcgcatagatgtctgatttgggattagcggaccagtgttcagcaacagttctgctatatcatctgctatgtgtggctatgtacagtagttacttttttcgttttagttattcaggcagtggataaatacttttgtctatccttttgaccatgcttgtggtcattgctcagttctgcccattctgaaatattttgaaacttgcacattactgggagtaaaagtgtagatgttgtagcagcagttcgattaatggcagcatgtatgttccttgtttgtcggtgcttgatttgtacccctatcacctgaacaattttgcatcactggtgatggcagtcagttctgacagacctcacaagcaacaaagcattagcgactatagttcatgaactgggggtgcatttagcgcatcattatttctgcaatcaaccaatagtgcaatgtgaaaatgttcctaagaatgcttagatttttgtagatagaagcatgctttgcatttgcttgatttgtattaccgttatgtagttttcagttgcacaacgcattacttgtaccccctttcagttattgcagttgccattttgaaatcatatgcaactttagttataaatttatgcaaacttagctataattttgtgcaactattgattttcagttataaacttagttaaaaattgaaaacataagtcgtgctgcctgttttgtttgtacagtacttagcgtggtagtgataattaaagctagattgctttttcacttatgaaccattagtagatataattgttgttcttctctaacggacaatattatctactgtttttgattgcatgactaaatattttcggtagatccatatacatatctggggtaatataatttataactaaactatccaccccttgtacacaaattgcatccctcggttattgtagtttccatttttaaatcatatgcaactttagttataaatttacgcaaacttagatataattttgtgcaactattgattttcagttacaaacttagttaaaaatcgaaaacttagcgtcatgctgcctgttctgtttctggactacttgtgcgctagtgataagtaaagctagactgctttttttttactaatgaactgttaacagatgtaactgttgttcttctctaatggacaatattatctactgcttttgattgtacgaataaatattttcggtagatccatatacatatctggggtaatataatttataactgaactatttaccccttgtatgcaaattgcaccctcttggttattgtagttgccattttgaaattgtatgcaactttagttacaaatttatgcaaacttagctataaatttgtacaacttttgattttagagttacaaacttgttaaaaatcgaaaacatggcgtcctactacatgttctgttttctagactatgagtgtgctaggcataagtaaggatagactgctttttttacttaccaactgttagcagatataaccgtttgtcttctctaatgggcaatattttgtcaacttcttttgattacagtactaaattttttttggtagggttttttcttacccgtgcgtgggatttcagtagctctttaatgttagtttgatctgattttttctgggactagggactgtgagtgcctttgtgaattttttttgggataaatctgagatttatatgcttggatgcatttgggtggcaggttccaaattagaggagaggtcagaggcaacagggataccaatgttttggttgacaatttttgcttttgtgtccattactacatgcatgcgataagggtgtctcttttctacagatgatgaaaaaaaagtatatgcagttggaaccatagctatcgaattttggattacaaatgtgaatttagctctcatatgcttttgcttgttcttttctgttaggtgcagtatacgaattcatcaatgtgcaagcaagcaagagaagaatttttttcagcagcttgctcttgtggcgaagcagaacttgtttttgctagaggtggtgcaacatatgagttctaatttttaggcggcattgtcctgatacttcacatgattttcatgcgttcactcttttttgtgtgtgacactgatggtgttctttagctgcatctgtgtaaaattaatgcctgaaatctcagtctagattataacctttttttcaagccatatatctgctgcatacagtatacaacattttttgggctgatgtcagatgcaagggcccaaatattagtccaaactattaggcaaaaccaaaagcccaaagcgatcaaattaggggcttgtcatgggcccccgaaagtggtttcataaatagcgcaatgggctgcttcatcctattttgttttttcgcacaaagctctttttttttctcgggttagtattgccgtaagatgcaaatctaatgacgcatgggatcaactgatcaaatccgaaattgcaatcgattgcagaataggtgcccccatcttatattcctcgttgaccttgtcttagctattttgtgcctcctgttttgcttgttcaattcatgggcctatcctcttgtaccgacttttttatgcgcccatgcatgtagacgggaatatagctgattaggcggcgctaactgtactcatgataagactagatctactaatcgatcatttcggaactgaacagggccatgcatacaagatgcaggtaatcaaacattcaaactctgaggtgttgctgctgcttatatattcacccaaagattgacatagctacacattcttttgctcacaaccatggatggcagaaaagctgctgtttgcttgatcattgtgcttgtgttaacacttggcaatcctacttctgcaggttaactctctctctctctctctctctctctctctctctccagtttcatgaatagtcatcacagaaactaaatcatcagttcactaatttccataacgtgttcttcgaaacaaacaagaagtgtttttaagtcattatttgtctggtagatatatactacttcatacttgacccaccaatgtttcatgtgaatttgtgattaagttattgtttccagtgtattaaagataaagtgagaggtcaccgtaattgagttgctcattaatgggtaaaattttcttgcaggagtgtgctggcaatctaataccaagatgcctttctgtgcgggttttatgtgcaagatctcctgctggatctcctcgaaattcaccaagcaaaatgtcaagagttacaggtgcaggggatcgggtcccaagggcagatgctactgtaatatttgcgacaaaaattactgattcagatagattttaaccatttatcagatcgaagggatcagtgatattttttttgcgttttttttctgcgggggttagtgatatctaattcttcaattattattagttagtctcattgggtaatttgttctggttattagctcatagttgtttggagttgtatttgttaatttggcaataattttgaagggggacatatccggtaaaaaccatcaaataagtgaaaacccgtaaaaaccatttctaaaagttttataaattcatgaaaaaattactagagataggtataggcatgaaatatattcataccaaatcttaagttaaaactcaacttcatttgagagaaatctcttaaatgaagttgagtttggacttaaatttagtatgaatatatttcatgcctaattttttcatgaatttacaaaacttttagatatggttttcacttatttgatggttttcactggatattccccagatggatctgtgctacaatgttatatgatcatattatttcgctttagtcggagtacggaacggctgcgtatatttgactggatgatccaagcgcttgagctgcacgcgcatggccacgcatggcatggcaaggcaaacatgcttatcagggcaatatagtacaattattatataattacattgtaacttgtatatagctacaatttaatttgtatgcaaattttaaaaatcctatggtaccacgctattttcgtgaagcgaaagccatgggaccgaatcgatctcctcaccggcgtgtgcactatgattttttttcttcccaacatgcacgaatcttgaagcaaatcgacgcttcaaaaccatgtgaaagccacattattaattatatgcgagttacaatataattacactacaattatagtttatttacatttgataaatttttgagagaatttactgagaaatatataggaaaattgttttaaaaaaaattaaacccctactacctccggccaaagaggttgtctaaattcgtaaaactaaaatatgtctagattcgtaaaactaaaatatgcatgtctcatctagtatccggtagcaacatcttagtaagacggatgaagtacatgatactgcacataccaaacatcggcaatagcaatacttatgatacctagaagaaccatgataatgggcgacagagataatatgtttgttttccattgtaccaggtgtaatctgttattttcattttcttttggaaaaagtacgaattaccatcttcccgaactattgcggtcagccgaattaccctcctgaatcacaaaaccggacatctttcacccccaactttgcaaactggataattaaccctccggctcaatccgcggtggttttgatcctacgtggcagtccaatcagcaattcttttataaaaaagtaggtggaccccacttgtcagtttctccctctcttctatctctcccaatctctcattctctctcctctccatcacgggcgacggcggaggcagcagcggggtctctcctctccatcacgggcgacggcggaggcagcagcggggcgaggtgagtgcggc

SEQ ID NO: 69557 - DNA, 1669 bp, Oryza sativa
  unsure (1)..(1669): unsure at all n locations
ggttaggtgcgacccgcgagcgttcctcctgcggtagtgcgctggtggcgtccggcgcatccgtgcgggcgcggtgctgccaccagctgcctcgcctccttcgtcatcgcgctccccttgccgccgctcgcgcccccccccctgtgccgccctgcctcgccgcccagccactgcttgcgcccaccccctgcgccgccctgccttgctgctgctgctgcctcgtctcctccgccgccgcgctattgagccggagggggggtatttgtccggtttgcaaagttggaggtgaattcggttttgtggttcaggagggtaattcggtcgaccgcgatagttcggtgcggtaattcgtacgttttccttttcttttttgtggagggtgttgcttttaacagtctcccatcagcttcgtcaacctcttgtctctcgtcgaagagaggttttcttttttttttctttttattatataaacaactcaacaacctggtactgaatggcacaataacacaagttgtttacatatatgcgacttaattaacaagaaacacattgcgcaatcatgcattcctctcgcgggacaaatgcaaacataaattatcaatagcgtgcaaaaaatgaaggacagcaaaactgcaaaattaacagatcgagaagcacaataatgtacttccggtttataggacttccactacgcataagttataaaaatttcttagagtggtaatatatgccgcgatgtaattcatttgctaaatcaacctacgtaatatagctgcatccatgtagtaccctacacaatttacagctagttttttcttcctatatatagatcgaataacatttaattcgtctaaatgtttttagactgaaaaaattcattatatttttttaaaaaatagaattatttaaatatgatcaataaagcgataggtgttcaccgatccgcgacaaattaaggctacggcattatgaaattaaatgctatcaatggcaccgtggggtctccaaggagcaccccgatgacgacacgcatcaacatcacaagcacctcgcacacgcgcctcaccagcttactcttactgctcccgccgccgccgccgccgccgccggcgcgctcttgtagccgggcgatcacacgattcacacggtcggcgccctcgccgtcagcgtcggcgccgccgcggcaggagccagcagccatgatctcatgatgatgcattttactgcagccctcgccgttgttgccgccgccgccgccgccgtggcccaagccagccatgatctccttgatgcacttgacgtgcaggtacatgcgttggtcagtgttcttggagctcgaaggtggtggcgccgccctcctgcagcgtgatggacagcggcatcttggcgcagcccgggtgcaggtccaggccgccggtggagctgtggtagtggaacccgcgcccgcgcacggcgccgtagcaggcgtcacagaggacggcgtcacggccggtgggtgccgcagcgtgggtgccgcgagggcgcagtgcgtgtgtagcacgaggtcgccgaaggtgtaccgcgtgccttcgccgggctccctgcacccgtcgcaaacgaagttggtggcggtgnnnnnnnnnnnnnnnnnnnnnnnnnnnnnnnnnnnnnnnnnnnnnnnnnnnnnnnn

SEQ ID NO: 69558 - DNA, 37415 bp, Oryza sativa
gtggcggtgtcgccatggcggtgaagaaccagcagcgtgcaccccgaccccgagcgggggtgggcctggtgggggacctcagcgggaagattatcagcagcagcagccatgacagccggccggcttagttttactttgttgtgttctcgagagcgcttctggcacaaaacacacacacacatatatatatatatgcacatatacatatatgtatacatgtacatgtacatgtacagtacatgtacatgtacatgtgtacatgtacatgtatatgtatatgtgtgtgtatatatacccatgttaattcttaaaaaatatataaccatgttggatggcgaaactagctatacgtaggaaaaaaaaaatcaaccatgcatgttagatggcaaagctagttatacataggaaggaacaaagtatccctccgtttcaaaatgtttgacaccgttaactttttagcacatatgtttgaccgttcttcaaattttctctaaaaatatgggtttgttggaaccatgccaccctaattttgcaaaatttgagatatgccacctgtatctcaatgacatgtaggacccatatgagtcaatgacatgtgggtcagggtggcatattacaaattttgcaaaatttatgtggcatggttcaaattttccctaaaaaaatttatgaaatatgtaaaactatatgtgtacatgaaagtatatttaacaatgaatcaaatgataaaaaagaataaataattacttaaattttatgaataagacgaatggtcaaacacgtactaaaaaatcaatggtgtcaaatattttgaaacggagggagtgcttcctccactttttactccctccgtattttaatgtatgacgctgttgactttttaatcaacgtttgaccattcgtcttattcaattttttttatgcaaatataaaaatacttatgtcatgcttaaagcccacctcatgtaaatcaagtcacaataaaataaatgataattacataatttttttgaataagacgaaaggtcaaacgtttgtcaaaaagtcaacggcgtcatacattaaaatacggagggagtaatatatatgatgtcatcggttttttaaaataagtttaaccatattcatcttatttaaaaaatatgttattattatttattttattatgacttaatttattgtcaaatgtcatttaagcatgactttagtttcttatatttgtataaaatttttgaataagatgaataatcaaacgtttataaagtcaacaacgttatatattaaaaaacagatacgataatatccagatagttgatgtcgtactaacagccagcaatccctaacagctgggttagcatttctgtctaagctagtggccaatataaacaaatgttagttcaaccaccagtcacaaaataatatctcaccgttggcactggtacaaaaacgatttttgcaagaggctgctaacctttttacacgggcatttatcaagtctaacgatcgacgcgccacgctagctggaatattagaaaatattataagtgcggcagatggggagagctctcggcgtgtccacgtaggataggaacagtgcgcggggtggcgattttgtgaaaaagtccttcgattttgtgtaattcgatataggtccctagaaaatagtacctatgagacgatattttgcgtagaggtccttataaagtacgaatatttcatgtgaaggaaagaaaaatcacgaattaggactgtgctctaaaaagtggaaaacgaggggctttttcgcaagaagacgccactaaccctaccacccataaccctagccgccgccgcccgttctccctcgtcctcccctctttctctccctctcccgccgccgccgcctccggcttccccgtcgcctcgcgtcgccgtcgccgtcgatcgcccctcaaacccttgctgccgccgccgctcgctccccctcgtcccccactctctccctctcccgccgccgccgtctcgcgccgccacctccgcctcgcgccgccacctccgcctcgcgccgttgtcgccgtcgcctcgcgccgccacagacgtcgccgcctccggcttccccgtcgccgtcgaccgcccccgccaccatcgcgggcccccgaaaccctagccgctgccgcccgctccctctcgtcccaccccctccctcgatgctccttctcccgcgacgacgtctcgaggtcagcgcccaactactactcctcgtcattttggttttggttttggtttgggtggttgatgtgtgggtggtggtggtggtgtgccttgtgtaggtacgtggtgctgagcacggcggtgaactgtttggggaggtcagggggggggtgatcatcttgctggagaagaaggcgttcgtggtggagctgttcgacaagtatgtcaaagacgctcggctccgggatcgacgtgctcgcccccctcgtcgaccacatcgcctacgtccactcgctcaaggaggaggccatccccatccctgaccagtccgccatcaccaaggacaacgtctccatccagatcgacggcgtcctttgcgtcaaggttataactcgctcctcgccttaagccgtttctgctttgctgcatttccaattgctggtggtggtggatttaatgagttgtgttgtgcgcgatcgagcttgcaattttgggcggctcaaactggtgtgctcggtttagtgtcagtagcgtcgcggaggcttgtggattgggttgtggctgtaccctacttttgcttggtggcgtcggggccggcagttgcggcggctttagctctggtcctctggatgactggatgcgtccttgcattttggtggttgcgagctggaattagtaactgctttgttgtttcttcggctaactaggctggtcccttttttctttttcagaggtaactgaaagattggggtgactaaattgtttttcaaaacagtaattggggtgactaaattgtttttcaaaattaaacgctgtccaaattgtttttgttagaatttttggggaaatttcaaattgcatgttctaggtaattcaattaccctgaaacaattttgtggaagcacattgaaattcttttattaataaattgtcattcctggttcttatggtcatccattttgctaaggtagagctataagtgtgtcacagtgtactgcatttgattattgctgctctgtttatttgataactttgcatgattgctgatatgttcctgtttttacttacagtgccagcaatttgcctccctcatcagggccacatctacatgtggagttcatctcccataaaagaggatccacatagtatacctcacacatgaactctgtaataagctgaggtgatctttatatgcttcaccaactggtgaccaatgggctcttttctgagaaaacagcccagtttcctcttaattttgttaattctgcaccttggtgctcgtgaagcaagtgcactaagttcagatggtatgtgacagtccatagttatggttggtatttgtgtggtacattagacaatctgtgctcatttactatgattcttttgatggtttcctacagatgaagcacttcttgccttcaagaaggcagttacaacttctgatgggatattcctcaactggcgtgaacaagatgtgtatccttgcaattggaaggttgttagatgtcacagtcacaccaagagagtaatttatctgtaagaccaaaataaaccctacataaatattgtgaaatacttaaaatttcaacctggcaattatttttttcccttttgaatatggcattttctaatataaaaagttcaccgccatcttcgacattggcagctccaacctctgggtgccatcagccaattgttacttctcagtgagtccctgttcgatgcactgttcaagggaagttctcttaagagtctgccaattgcgacttgtgcagttgtgctaatgatggatttttcctggtgatgattgatgcaggttgtgtgcttcttccactctcactacaagtccgggcagtcaagcacttatcagaagaatggtctgtgtcttaaaactttccccaaccgtgctattatttgtgttgtgagtttgcaacaattatggctatcagtctatactattacatggatgcactgaaatcttccccctgtttttttttttttttttttttgttatttactctacagctggtggcatatcttgtattgtatgttgaaatttaaccttttaaagcaaaattggatttggtcgaaatgatgctagatggtggttatttggatttagttataaggatgctagatggtatgtttggattacagtgcgaatcaaattaggaggttgaagctaagaggtttttattcgagttaatgtttttttttataaaaaaaatctaccaaaaagatatatatttgatttgcatatatgcattgaaaattacacatttgcttggtggttataccgtttgtccttctgatgtatatgatgtatgtttacctgtaggatgttttcctccgttcctctatcatcattccctatgacgaggtatggctgcttcactttctgtgttggtcttgaatgattctgattcctaattattttggaagcttttctcataaaccaaaatggttttctaaacctttccacgagcaaataattgtttgcaatgcccttaagactagatgaatccatttttagcatctatgttgctacatcaattgaacaatcaccacctaccgatgcatttccttaagttaatgaatgaccgattcaaataaaagcgagaactattgaaattcttttaaattgcaaccttgccactgccagtgagtgatagaatcaagatgatcaattactccaaagtgatctttagaacatatgtggctctttgttcaaacttctcctaatttctctgcagtccaggtgatatcttcaataaatgtcaaaatcattaagaacaacccacagttgaataggcaggataaacggttggtgctcccatgtggcgatcgtggattaaagtaggaacaatggtttaattgggttattcacggagaagtgatattcgttggttgtcatggctgcctggaagggaattacaacatttgattttaagctttaatagcttaggtagcgtttgggctcactaaagtgcttcctttttcttatcttttagacttccactatgaattatttaacacccataaaagaactttccttgcatgattttctttattatgaaatcaacatttatattgacaaacctgcttagcttcagttggacaatgatacgctgcagtaaggcatctcattgaaggacattggtggattctgcactgctattctattacttaacttcagtagagaatatatttgcccttttgcttgacttcatatggtgttatatttctcattttagatggacattcgtctaatttatctgtaccgtgatctttttctgaaaatattctctgcaaagagaggtcatctgaagcattgttaaaaaacagtaagtagcaaaaaaaaatcatggtacaggagtcaatggtacgcagtagtgaaaacatagttaggagttgcatgttatgttgatttgctattccaaaacgtgtttgaactgtagcaggatgtttgttcctattaaaactagagcttttagccatgtattaccttttgtagcttccctgctgattacgttcgaagaaaacaaaaataatccttattgaaatatgcacattgtaaaacagtaaggggttcttatactgttttctttaattccacaatacagtaaaaagagtgagatcatatggcaacattctttgtgaaagcaacacatccatatctggatgtagtggttgccataatggagacaaggagctgttgaatgtagtattgcttgatgttaaaagtgggtcacaatttccagtgttggaatctaattcagtacatggcaatgaaatttcattgacctctgaaagtgaggtatcaaacttaaggttggtttctattcattcagggttttgactttcattcttctcatacaagtattttcctagaaaatcatgaaaaagcatggtgttttaaatagtggagtactaacattcctctctcaaaattcgctacaggtatactcccatggtacctcagatacatcatgttctaggtgttgaaactgaaagttgcattcattctggtgattcaaactttctggatcttgaatggctttcagcttcaggcaactcaagcgatgaaaggtgtttacttttgcattgctattgtatttttttagcgtttttgactgacagaatatcatcttctcagtgacagtcaatttgatttacacacattttctttgccttagtgtaggaaaaagtgaaggataattattagttgattatcctgtaaatttcttacccttcatgcttaattccatatcaatctattcagagttcttttgctctcactgcatttccatgtgataaacacaaatctgtagtatcgtgctgtaccacttgatataactatctgtattgagaagtaaaatggaaatattatgttgccacgcttcctaaatccaattaacaagtgtcttatgagcttccattgatactgatttgaaaatatcctccgaaacattttttttaaaactcatttaatgctgatggattgtgcttgaacaggtccattgcaattagtactccagatgtgaacctttcagcggagaatgttattgccacaatgtcttcttttgactggtagatttgtatgatcaaatatagttgtaccatcaccatggacacattactccgatcattatgtaaaactttattttcattttttatatgcattggtgcttcatctttagattgtaatgtgtaagagttttgttctcagtagaatctgtacaacgatgtatgcaaaattactcatcaacagcatcccctgcaaatgtattcgtgggttttttccttacataatcattgattcagcctgaaaacaaatgattagtctacagtaatcaaccaatctatgtgtaggtggcgcgccattggcgcgccccagcatctagtataatatgaagccgagcctactggcgagtcttaaaacaaaaaaaaaaagtacgatgagtgtgtaatagtttcagagaaacttagtaaagaatctatgtagcgtatgatgcgcatatctaacatggcaacaaaagctcagccaacaataattcaggctgtgtttagttcagcacaaagtttggattttcgttgaaattggagatgatgtgactgaaaaattgtgtgtttatgacatgttgatgtgatggaaaaggactgaagtttggatctaaactttagatctaaacaccccctcagccgctcacttgatcgaatgtccatgtggaagcgaataatggcgccacatatcaaaaaccgttgactccacaccaatcaagcctgtcaagctcatgcaccagattgtaatgcacatgtacgaaatcacctatatatatcgaaaaaaaaaacgcgtctgttaattagatggccggaggaatgtcagctgggaaaaatcacatgcccatgcttgtcagactgtgcagtggtgctctttcgcaatcaactatatataaatatttaagcaacaagtcaaattctaaaaaagaaatagtaaaatacacggccggtccttaaagttgagcgcgggtgtcacttaggtccataatcttgtaaattgcacatctaggcccaccatcttgtttaagtgactcattgaggtccaaaagacctctgaccgggttgactggcttacgtggcggtccagcgtggcaacatatttgcattttgccctcctttttgattccccgtgtccgatccaatcccttctttgcgtggcgcatgcaggaacgcgccgacggcaacgtgcgccagcacgcacacctgcggcacccacctgtctcaaccacgctgcgcccgctggcgtgcctcgtacccctctggcagccgctcgccggtgttgcgcagcgcccagagaaaccgcacaccgtcgtcgacgggaaggagaaggagcaggggaaggggaaggcccccgctctagccagccgtgggtgcacgcgacaagtggctgcggcagctgctcaagtcaagcttgccctgccgccccgctgccgccatggagctcgcacccgcccagctcgtgccgaactcgccgacgcctcccccacacacgcggccgcggtaggcgacccctccccccgggcatggccggcgacacctcccccgcgcgcgccaagctcaccgacgcctctagcaccaacgaccagcgggaagggagaccgatggatctggccgtcagtgaggcgtgagcgccaccggcacgctagctacgaagacagtgacggcgctccgcaagctctcctctagttccctccgccgcctgccaactgctgccacattcgcccgtcgctgctccgctcgcaccccgccgccgcgcttgccctccaccgttccgcccgccgcccattcgtcaagaaggatttgaggtccacgacggcgcggcgtcctgatcttcgagctcgtccgccgctcgcttcgtcccctctaatactgcgtcgttggcaatcatgcgtcgcttcgtcgaggtccacgatagcggcgacggaggacgctgatgttggcgaggcgaggccggagaacgtgacaagcgaggcggtgcagccgtggtgtgcgactaggcgccgcaacagctcagccatcggtatgacatggccagcgaaggggctgacgatgaggatgacgtgcggcggcggtgggcgatgtgacgacggaggcagctgagggatttgggggttctttttggtgcccagggctctactgaatgcaatgtagatggtcagcttcggtcaaaccgggtttggaccttaatgagtcacttaaacaaaatggtggacctagatgtgcaatttacaagattatgtacctaagtgacacccgcgcacaactttaaggaccggccgtgtattttactaaaaagaaatattaagcgacaagtgagacgtatattcacaacattcgacggttgcaacggggccaaattctacacggagctttgtattaatttttgggaacttttggagtagttgcctttcgtcgtgggtgctgctggctctcctcgaaattcaccaagcaaaatgtcaagaattacacgtgcagaggatcaggtccaaagggcagatgttactacggtatttgcccactatcagaagggacaagtgatgtatatgttaattctttaataattattagttagccttattagttagcctcatcgagtaatttttggtgatcatagtgccttggagatgtttttgtttgtcattgattaggatgatttaatttgtcgctccaatgttatgtgcccctacggatcaatctctctgtaattgtttttctgaatttgggtgcatctatcagtttatcatatcttcaacctcgatgtcatcaattttgtaatttttgtcgatggccatgatctcttccagtattgatgcacaaattagttgagaacagaaaaatgtttggaatgaatgaacaagcatgaattactaggctccactgtaccagtccaggtcaccaccgattgtcgaaactggatttcggcaataataaaagggggtggctatcaagctggaaaagtgtatgggtttggagacaaaggatttatacaggttcaggccttcttataaagaagtaataccctactcctgtccggggatgaatccgccgagtgtattattgattgtatgatttgggaaaaatcaacatctgcccctagaggcgcccggaccccccttatatatgggaaggagtccggattacaaaagataatctatattcctaacggaatatgaagatacaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccgagtgcttcaaattattcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaaagacaaaataataacacaatttgtgcattatatgacaaaagcatacgcgacacctaaataggcatgctagccgactgctttttagccacaataaaagaaatccgagtggtgtacactctaaaaggttcacgaatgaacacacttgacaggcatccgaatataaaaactctaaagattacccaccaagtattataaagattatggtaataaataagtcaaatagcctaggccatgactatttaccatggaaacaggcatataacacgccaaggaaatgactataataaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaaatattgggctgaggtactgttcaggcctaggcccattcgtacctccgatacccttaactggaaaatccgatatccaagcgacgcttcgtcttccccgccggaactctcgccattttccccactccttgctacagtgcagaactgcgccggcgaactagggttcaccaatccacccaaatccaccttcgaaaagtacatcaaaatccttcccgtgatccaccgcctcaattcctcacctctcccaagccatccatcaaatcaaatcagcgcattcgggtaaaatcgatggcggaggagaaagaaagctttgaaggccaatgggcgccatccgacgtaacggaagagaacttgaaggagatggtggcgcacggcgttctcccagccaaggagatcattgggtggcggccagcgtgcggtgaggcttttccgacccctgatacacatgagatcgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgtttgtgaagcctttttagggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtacacttgtcttcctccagtgtaccaagatacttggaactctcttccaatcggagatgaagcagtacaagccttggagttgttggatcgtatgttaaatcttaaagaacaaggattacagggagagcaaatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcaccaactgccagttgtgccatataatgcattcaatccgcctccacaggtatgcatcggaaaccctcaaaccgtgatcagaacataattttatcttcatgctgagttgactaactatggaggcatcttgttcaggaatatgcattgatgaagtcagatccaccagtcactcatcgccggtctcctcgccaacacaccgctcagggaggtggagggccaacgatcagaccagatccgcaacctcagacctccaaattgactggtcaaacaggtcctcgcaagagaaagctggtacttgatgatgatgaaggcgacgatgataaatctggggataagggctcgcctaataaacccccaaagcgtaccatgcccaggaaaaaactggctggccgtgcaatgccaaagatcagaacatcttccaggtatcagacctctcagtatgattccgcttcggaatgttttccgatgaaaataatgctgaatattgaaagaacactctgcaggaaaccatctgatatagatccatctgggaaagaccccgatcctgccatgacagagcaaaatatatccaaggaccccgagccgactgctgaaaaccagccgactgctgaaagccagccgactggcgcccatacttcgggcgataggaccaatccgagtgacctgccgccgactggaaaccagtcggcaacaactgaaacggcaacaactcaagagcccccgactggaaatcagtcggatgcaggtcctgatcaagagatccccgaagtagaagcgcagacgacgacttcgcaaggaccagaggctggtaacgactcgataatcgggtctccaaataaagaacaaagatcacctcacgctcagctaggtacatcttcaggttagttgtcttctcaaacaatggcgatttaaataacctcagtttatccgtctaacgtcttggaaacacatcaggaccatcaggtgatgacggagaggaaatccctcgcataaaggcaaccgacgactctcgtcctcctatcttgatcaaatggtgggacgagaactcacaagccgccggtatagtcataaaccgtcaaaaagaagatgaagaagtgtgccagctgaagaaagcgctcggagaagccactcgtattgtaaatgtaagtcctccgggtgacggccttcggtaactttgttttctttttagcagaacctaaccgtgaaccactatgcagagaatccatcttcgcaatgaggccaaaaccgcaactttagaaaggctggttcctcatttgggaactcttgaagcggttagggaccagctacatgaggccaaggagcacgccaagaagacggagaaggaattaagggaccgaatcgctcagctccaggattcaaactatgagctgagtggttcatcaaaaggtaatccctagatccgtttcatcggtttaaactggcataactgtatcctcaaccatctgaatttcaaacagcgcaagccgccaggatggaacagatggcgaagcaaattgaagccctggagagagacaagacagaactggctgcgcaaagggactcagccttaaaggaagttgaaggtaccgctagcagacaatctgagcttctctctttataatgcaataaatcctcatcataaatgtgttttgtagatcgcaaaataaaatcgcaagcccaatttgacgtcttggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagcgatgttgtagagcaatttcgcaacaacgacctccgccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaggaagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgataaagttaagcgtagaaacgacgaagatgttcaatgttccaagaattgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttctcggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccgttggccctctccacctgtccattgctcattgggtgtgctactgaggcatagcaaatcttgattccaaagtcttcacaaaagtctttgaaaactccgccggtgaattgtgtgccattatcagtgatgatccgattgggtactccgaatctgtgcacaatgttgatgaagaaatcgcgagcattatctgctgtaatcgtgacaacaggcttagcttcgatccacttggaaaatttgtcgatggccacgaagaggtgcgtgtaaccgccgactgcctttttaaacgggccaaccatgtcgagcccccaaaccgcaaacggccaagacagcgggatagtctgcaactcttgagctggtagatgaatttgtcgggcaaaaaattggcaaccttcacatgtgcgcacaattttgtcggcgtcggacactgcagtaggccagaaaaaaccctgccggtaagctttgccaacaatagtgcgcgctgcagcatggtttccgcatatcccagaatgtatgtccttcagcaattgtctcccttcctctaaagatacgcagcgttgcagaattcctgaagggcttttcttgtataactcggcttcatgcataacataaagtttgctccgccttgaaatccgctcggcctcatctttgtcttgagggagttcttgagaagtcaaaaatcgtatgaggggctctcgccagtcggcttcaaccatagctatgtcatgagtgtccgcagcttgagtagcatctttgtgaggtactgtcggcgaataaaggtgctcgacgaaaacatcagatggcgctgcctcgcgcttggatccaaagttcgcaagtctatcggcagcttcattgttgtgtcgaagaacatggctaagctcgagtccatcgaacttatcctccagtttgcgtacctcttgtcgatatgccatcatgttgtcgtcaatgcaggaccactctttcataacttggttgacaaccagctgtgaatcacctcgaacaattagacgctttatccctagggaaattgcaatccgtagcccatgaaggagcgcctcatactcggcgacgttgtgagacgccgaaaaatgtatccaaagcacataacttagtctttctccagtcggggaaattaaaaccaccccagctccagtgcccgaaagtctttttgacccgtcaaaatgcatggtccagtgctctattttctccacgggggtatcctcttggcactcggtccactcggcgacaaaatcagctaacgcttgagacttgattgaagtgcgaggcttgaatgatatgtccaaagacatcaactccaaagcccacttagcaatccgcccatttgcttcgcggttgtgcagtacatcgccgagtggaaacgatgtgaccaccgttaccgggtgaccttgaaagtaatgagacagcttcctggtagtaattaaaataccatataacagcttctgaacctgagggtacctcgttttggagtcggccaggacctcgctgacgaagtagattggtcgctgaactttctggacatgaccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgaacatccttctgggtgcttggcggtttcatgttgaggatagcagtaactttctccgggttggcttggatgcccctatgagacaccataaaaccaagcagcttccctgacggtactccgaaggtgcacttttcagggttcaatttcatcctgaaagcacggatgctcgcaaaggtttcttctagatccgagatcaaatcatccttttgtttggtcttgacgactacatcatccacataggcttcaacgttgcggccaatttgtgttgagaagcatctctgaatcatacgttgataagttgctcctgcattttttaatccaaacggcatggtgacgtagcagtatgcaccaaaaggcgtgatgaatgaagtcttcaagcagtcggattccttcagtcggatctgatgataccccgagtagcagtccaaaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaaccgggtttgccagccagtcgggatgaaggacttctttgatgaagcctgctgctaacagcttggttaactcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcggtttctccactttttgaaatcttggcagcgggcacttctccttcgctcaccgtggttgcagccagtcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtatgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccaaggggccgccgaagatatggttgagctccttgcggtggtcttgaaatccagccggggtgtcgccgtcgtccttcttccttgacgtgctttgttcctcgtcggagttcttccgagcaggcttggtatactgctccgcgaactgcttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcagaaaatcgtcggatatattctcgaagggattctccggatttctggataacgttgtaaagatcatattgtgtgccaggacgctcgaaggtgccttggaagttggcgatgaagtggtcgcgtaattcagcccaagatccgatcgtaccacggggcaatccatggagccaagatcgggcggaatctgctaaagccaccggtaaatagttcgccatggccttgttgtctcctcctgctgcgcggattgcgagaccgtagacggtaacccacgattcggggttagtggtgccgtcatacttctctattccagtcggtttgaagccggctggccaatccactcgacgcaggtcgtcggtgaaggctgctactccgtcaaggtcgtcgtcgtggcggtccggtgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgtgctgaggcttggatgacggtagtcatgagatcggaagtggggaactcggctgccagtcggcgtgtggacgctttcggagttaactgggaccgaggccgcaatcatggtcttcgtctggttcaagatgttgacgacgtggtcggatcgattgagctcgttttggttgaggagggtgtcgagaagagtgatcgcggcaaccgcattctgttgaggggtgcggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcttccagtcggcgacgttcttcggtctcccggacttggcgttgctcctccgtctcattattggccatgaaaacgccaaagtagagaggggtgtagttgtcatctaggcttccgtcgaagtcgtcgtagtcgtcgaagtcgttgtagcgagagctaaattcgtcgtactccacgatgtcagtaggacgtgagtcgacggtgggagagctgttgtagtcatctagctgatccgtcgaaaccgtgccgagtggttggaggatgacgccgacttccctgaagctaggcgaaatcggtgttgaagccgacttctgcctaggcctacgggatgaagacgctgtcgtggtgaagacggccgctaaatcgtcggggagcttcatcaggactggtgggtaagtcccatcatcttgatctggtgtcgtcggagaagatgcgatctcggccgagtggtttgaagccgactcggttgagatggtcttgaagtagctttcagccgcgttcgggaatccaaacgggaccgaaagccggttctctcccgactggtctgattccgagtcaaggagagaaatcttgccgaagttgttggtgacgaagtcgaggctgccgaaccgaaacgtctgcccgggtgggaagacgaggtcgtcgatgccggagaaaggacccattgcactgatcggcgaaaagcttgacgctacccctacctggcgcgccaactgtcgaaactggatttcggcaataataaaagggggtggctatcaagctggaaaagtgtatgggtttggagacaaaggatttatacaggttcaggccttcttataaagaagtaataccctactcctgtccggggatgaatccgccgagtgtattattgattgtatgatttgggaaaaatcaacatctgcccctagaggcgcccggaccccccttatatatgggaaggagtccggattacaaaagataatctatattcctaacggaatatgaagatacaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacaccgatgcacccataccatcacctcttacgagtttagctctcgtagaaattaggggtcagtgatgactgatctcatctctgacgggtgaaggcccgtcgatggtgactgtatagaacttgtcacagatgactcaatctcgatcgtctcataagttgtggcccatcagtgatgagtgtaacccaacaaaaagataaaagaataagagtgaagaataacttgtgacccatcacaattacaggtgtgaaaaacccagttaaaaaaataaaaactaaaatgatgctcggttgcaacaggaagcaaaatgtgtattaacagtaatatatctatggttattaacccaaaacattttacttcagactaactctttctacaagaaacaaatgacccgactcttcttctataatcagccatctgcctctccaaaccccagcagcacaaatcagtgggcttcaaaaagaacacaactcaatcagaaaattggcatcaaaacttgcaagatccaaaacatgacacaaacacaaaaaaaatacttgcaaaatccttgttgcctcgatgacttgagactccgaagaacgacatgacaatcctgaggagaccggagaagaggcagaggccgcggtggtgcacactctaggatggaccttggggtaaaggcagagaggcggtgatggcaacgggattatgggattcccgatcttccttcaggtgaagataactatcgatttggtggaaacttgacacacacgatccaacttccgatcaacatgatccaaaccctacaatcgtagtagcacgtcttctctgattatcagccatgctaaaaccgattgaccttgccgagaaggctaatccctgcgtgtgaatcaaagaacacaagtaagaacaagaaaaacaacaacttaattgcaaatgaatgattatttaagaactcgacgttggggtttcacaaaccaatctagcagcgaaactgcgaaggcagaaataatctaagcaaaacacaaccctaactcaatgataactactgaatatataggttctagggtcgaccttagacccctgtacgcctccctattagactccgagacgacacacggcccaatgggcccaaagacggggacatagcacctgatagattctgaatgcctttttgttttgaagattcccattgattcggaaggaattttgacgtgggatcagatccattggaaaggtggtctcgttagctttccatacatatgtagaacgtcgaaatcggagtccaaatacaacctggatgatgaatttagtgtggactgctcctggagcccgaagtggaccttcatcttgtcttgaacgtccatgatgatcttgtccatctcctaacctctctccaagtgctccatggttgtctctatagttcctaatcataattaaatcattaggtagcaatctatcctcaagagcacataaagaagtacttaggaacgagctcacttgtaaatttaattgtcgggcacgagctctagtgattggaccttacaaaacaacatgaggagtagcatgtgtatccaaaggagtgatgccttcatcaggtggccaccgatgatcttggagcggaggatggaggaggaggcggctagagcttaggggcgttcagatccagtggtccccaacctcctggagaccaaatctggtgtctcgtagctcggaggcggtgaagaggcagacaatggctaccatgcaggagagggtggaggaggtggcggccgaagctctagggaatttagatccggtggtctccaacttgttggataccagatctggcgtcccattgtttgttggcagcggagaggcggccgctgacaaccttagggcgaagggtagaggaggcaacagccgaagcttgggaatggacgatatgaggagatgacgacagtaccagccaaagctcagggcagataggcaagcttgccggtgcttgggggtcgacgtgatgaggacgttatggcggtgacggatggagctcaaatgcggagaagcgagctcgctgacactcgaggtcgatgtgacgacggcgacggcgacggtcgtcgcttggggtggaggaagcggcctctggcgctcggggcccgagaggacatgggggccactcagggggtgctcagctggggagggagagctatggttgattggttgctgagataaaaagaagggagagagatgtgtggataaggacttagtggtgtcttcgatttctttcgatgggagagagagaaagagctatgatgggtaaaagaatatacccatatacgaggagtgtcctcacttgtgacggtttatatttttttgtaccttcacaggtaaaagggtcatctatgatgggtctataggtgagcatgtcaaacgtgctatgtgtcgggtgcacatactggcctgccacaactggccccttatgtgtgatgggccacatctagaatgggctccaattgaacccatcacaaatgcgttcacctgtgatgagacactttggcccgttactgataggtcatcatagatggatcaatctggtatagttctctgtcaagaagataaaacagtgcgagacaacataatgttcagaaaatgtatccaacaagtacgtctggcttgaactacttttccctgttttcagtttcttgtttcagaaaggaatgcgatttaattcctagacatgttttcacaatatatatgcacatgagtgattagtcaagaatgacaacggtacagggtactggaacttcaaattaaggaacacaaaacatctttccctgtagaatttaataacgaaataatctcacaacaaccaaacactaccgagctcacacaccctcccagaacaacaaaaacaaaatacaaatccaaaccaataaattaatttccataaataatttgcatcgtgagtatttatgcaatacattcgttcaaaaaaaaagtattaatgaaataggacaagcatgccggaggagtttaattatggcctcacctttggtcagagcttgactgagcttggaggaggcggagccgaagactaagctgatcataaattctttcgataacagaattagatctagacatgtacatgctagctagtataagacgacgatctctttgtttaattttgcgtgtcaatgaatggataattttgctagctgctagtaggaagaaaaatctctgggatttaactagcatatatagggtaaattttgtggaaggacactcaacttttgcatgcgctattcgattcatgattacctttgctgaaatacggtgaactttattttgcgtggttgcctgcaaagtggcagtacaaaatattgaaaccgctagtttatgtctctttgagcaggtattgggagcacccttatatatggatgtgcggcaaggtcatttatttaataaaacatatttaattttctcattaatttttatactaacccaaagattaataataatataattaatttacttatgaggaataacaacccctcccaaaaaagaaaaaggatcactcagtctttgtagatgttgctacttaacccttcaaagattcacgttgcatttcttcaaagattcacgttgcatttcagcatcttcagttttattattctctcgatctatacatagacgtaatcttgcatgcaatgtagttcttcaaagattcacgttgcatttcagcatcttcagttttattattctctcgatctatacatagacgtaatcttgcatgcaatgtagttctttcttccagctgaacagggccaagcatgcctgcatggattctcctatctaattaacttcctctcacactcagtcagtcaaatgctgttacttatcctcgcatgatttacgttgcattacaacctacatcttcttcagttggattattctccctataaatacacatcatcatacagttaaacctcatcactctcttgtgtgacagaggagcttgaaactttaaagccgaggtcttagtattagccgttagctctctcacagccaattaacgagccatgggtgagagaaaagctggaatttgcttggttttggtacttcttctgtcaacacttgcgcaacatgcttatgctggttagttcttcatgctccttgacctcccttctctatccctctccaatgtattgtgttcgagtatcatttcatatgtattatctattattcaattgtatgtagaaactgaaatcttaatttaatttttatttcttatgtgatgactaagcaacggcaaatctaatgccccgagaccccggcccggggcggccgcctgatgtcatcggtagttggtacattaaaattctatataattggaaggcccgaagatagaagttttatagaatatactagctatggtataattaactatgttatgcctatgctagctgtaaaactgttatggattcaccactatgagtaaggattcaccactataagtaaggataaaagagattattataggttctattttccaatgttttgtgtgattaagatcatcaaccaagtgagattattgtaagttcactggctaaattaattttgtagaacaatggtgctggtatgaagtttccgtgtcgccgatctgtgccggtttcacttgcaagttcgactgctggtttttcgccaaagtcaacaaagccaaagtccagtctcacaagtgcttgggaaaaggttacaagatcaaatgtttgtgccaactttgtaagaatgtttagtaccactgaagacaagatattatgttatgttctattgtaattgtaggagttttattaataatttgcagaagtgatcttttagttggttgttgtcacatcctgattttcgtttcaggatttataaattatttaataaattaataatagaatttatattaaatgttcattaatttacaagtgaagttaaatgtggaaaataaaatttcctaaatttaaagcatggatggatttaatttttattaaattctccatggttaattatactctctggaatattctcggatttttcggagctcaattcctaatttttaatcttacaaagagcatttcagtaattacccacatattaaattaatcattaaatggtctaattataattttgttaagtactttgcgtgtccaagtattttcaagatttttcttggaattatttgagcataggaagtatttttaacaattcaaagatcatttcagtgattaatttaattggaaaagtatttaaaatccccttctccttttcgggccgaaataggaaaagttcagcttctgtcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatccggccttttatctcgtgtatttccaaaattagttgaggggaaatactcctcttatcctcctctatctttacccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccctctttcccgtgatctctcgtgctccgtagcctcgtcgccgcgtcgcgcaagccgccgacgtcgccggtcaacgtgcagccgcgctgcgccgtcgccctagccgtcgccgctgcctcctctcgccgccggcgggtgcgcgtgaccgagggctagcccggccgccccttccccgtcgtcgccggccaccggagcccctccgccgccggtcaaccgagccgccgccgtcgcccctctcgtcgccggccgtcgtcggtcgttgttcggcacttcggtgagcaccatcgggttcgtctcgtcgttctctacgtgtaggtgtcctccaaatccgcagccggtcgccctagctccggcgaggtcgccatccgagccggccgcctttgatgatgtcatcatgacatcatcggtttttctttttcccgtttttctaatagattaaatcttcggaaattcataactaaatcatcgtaactcggttttgagtggttcaagttgctaaattcatctaaaatcatgatctacatgttcgtttactttatatgtattgtttttttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcatactattgggataacttatgactcactattatttaaggatggcttaatgatagttcacgatggttaatcgtgattggttaattaattacttgccaactaaaacttgataatggtgggttgtgagcacatggttttgagagtcgtgctcatggcaattaaggaccggttcgcgagctactattgtgagacatttaccgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataactggtaacaatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgtaaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacagttgtcgatcgttagctagtagtgtcattgaataatttgtgctagtcatatgttcgtaagctagctagatccctaaatttatctctttgaagtacaccgtcgttgttaatttgtttggcattatgattaatttgacttctacctccaatggtgtactgtcacaatgtgcatcttatcaaattattatataatttcgatacatatataatgatatttctcggcgagggcgtttcagcccgagagaaaagaaaatcagagcactgttagtctcctgtgtattccggccggtggctatcatcatatcttattatcttatcttatatagtgaaagcaacaagctttcttacacgagaacacgccacatcatcaaaaacatatcaaccgttgaataaagaatttagataaataatggccattggatcaaaaggttacatatgcattaaaaaaataacaatagcataaacatatgggaatttatagaggtttctagtgcctcctcttatagacacatggtacaaagagagcgggggcaaagataatgaagaaaaaaaaaaccaagaagcttctagtgatttctcatatagcacgacttagctaaatctatagttagctagaccaatagatactttgtaaataaaataactcatctaaaatcttctataaactaatagatcctatacaacaaatagttcttatatggaatcaaaagtcgcgcaacgcatggcttgttatcattggggatattaaagagacgtttcaaagtttctaagatccaaaagtttcaaagacgcattacaaatcgatctatttaatttgtaattatttctgtcatttcagtatcatgatatgcaacctctgtccaggtgatgccatcagaatttgagttgatgatctctttcatcgtatcgatccaatgcagattgattagttgagaatatataggaaatgtcggaatgaacaatcatgaattattagaaaaatgtaaattaaggaaaatatatccaacatgccttaactctcaaattaaggaatgtgactcagtttcaagatttgtgtttcataacatgttccctctgctcaaaaatacatggccatgtgtcattttttttttcaaaattggcttataaaaaaagtaatgaatacttagtttgaaaacatatggtgtgttgtacatatgtcatgaaaagtacacatacaatctcataaaagtttctacggaaattagaaattataaccactagtcgctaacccatgcattacataggctactctttaatattaaaattatattattacattgcatgtgttggttgtgagttgatattgatctgctcatactaaaattagggtccacgttagttacaagttactacttatgaattttgaattctagattttaattaataaatactaaattcagagtataagatggatacgatatgatatttttaattatgaattttattactaaattagagtctgtgctattttcatttgtgtcatttgtttatttaacatgactctcagcatgaactacattcacaataatccgatgcatcaaatcaatttctagctaatgtgagagttcatagaaagttttaattagcataagtgcaaatagattgtattttgttttactgatgaaattacaatcatgaaatatgctatccaaccttcattaatctcttccaattaattcatgtttttatactacaataatattattatttgcagcttactattggaaccctcatatccagagaaaatttagtggtaaagaaaaatgtcaaagcacacctcattaatagaaaagtagtacacatgggtagacaaagaatgtacattgaagagataagatttctaagtttgcgaggtaagctaagctttcttccttgtccatgcccggtttaagttcaagcctttacacgaatgctcgtatttatgactaattattctttcaatatgtagtaggtgacgatatatccatcaatatcgagatatttgtgatgactttgtttattctatgatattctaatccagtcttaagaggtgctcatacatttagaatttgtgtgtgtgtgagtgtgtgtttataagagtatgtgtttgtgcgtgtgtatgagagtcgacgtttgtactgcatgtcagattatttaatttgccaagtgaggatagataaaaggacataaatcaaatttagagtttaagttattttgggacggaaaaaacagatatagcaagtgaaaagcagtttaccaaacaagaaaaaaatatagtttaccaaacggaaacgactatatatatatatagatgatagaaattattagtaccagacatctgacgcaacaagaaaaatgggacgagaaaattactaaatcttgtccactccacacatccatacatgctgtaatgattttcaaaatatttttttcttttgaactacttatccaatctatgatataatcacaccattatatttgttataattaaatctcatattcttacattctgatgaaagaaaagatatgtttcaatcctttaaattaaatgtttcagacgtgatatatagaaatatatttcaaacatgtgtttttattatgtttcataaaataatttaaatgtttcactaactggtgtttcagcatgtataacttaatgtttcaccaatgaccgaagaagtacaggatggtcaggctcctactctctctcctgtcattctattgactccctcaccatgcatgcatgcatacatgtattagtgatcttaaaaatatttttttcttctaaactatttatctgatgaacgattcgatcacaccgttgaattcgtcataattaaatctttaaagatatcccatgattatattctgataaaagaaaaacatatgtttcaaacaataaaaacttattgtttcatacgtaatagcaatatgtttcaccacgtgttctcattttgtttcacaaaatttctatatgtttcataggctgatttttctgtttcatcgtgtataacttaatgttgcatcaacggtcaactgaaacatttgattaggcggtagccgttaattaatcacactcatatcataagttggtcatgatgtggtgcatgcgtacattatattggtgaagttttccggctgaacaggtccatatgcatatgcatgaatattcaactaactcagtcactgccgttatccacccacatttcacgtcccccatcaatcgagcgcctttgatttctcctctctataaatagacatcttatcatcatatctcttcatgatagaacagtttgattcccatatcataggaattagttatcgattctgaagctagctacaagtctcgggtaataattaagcccgatcagagctaatcagccatggttgggagaaaagctgccatttgtttcgtcttgatgcttctgttatcacttgggaattctataccaacacctataggttattctctctcacacacactgttatactcatttttttatcaaagaatctcatgtatattctcattgtgttgaaggatatacatatttaatttgtcgataagaaccaattcatttttcagtacttttaaatgtttctcgatttttaaaccgaaaacttgatttttaaatgtttcttgtgattaattatggcaaatgaaatgagattattaatggtataagttactgatgggttaaattaatttatggcagatacttgtacgcaatctgtttccatattgccgatctgcgtgggtttcacatgcaagtaccactgttgggttttctcgaaattcaccaaaggcaaagccattgatcacaagtgcttgggaaaaggttacaagacaaaatgttactgcttgatttgcaggaaatagtagcactgaagatgagatgttgccggggtcaatgatttgctagagtctttagttaggttattagctagtctggtcgaataattgatttgtgctaatttttttggtaatagggtgattgattatttcaatttcaaataataatatattatcttgctatgggaactctctataaagtgttgtgatactggaatagtcttggtgattttgagaaggagcaacttacatatggtgagtgataggcagggttaaaaaaatatttggtgacccattgccgcttgggagtggtttcatcacttatcacaggttgagctcaataaatgacaaaaaactagtgaaatttagacaaatcttgccaaaacattgattttatttttgaacttgttggccagttttccaagcagtttattgatcttgaatttatttcatcagatcttaaattttcatattggattattctatacttaattggagataaaaaaaatgctcaaatgctatggccatgggaacaatcttattatttgagtacatgactggctacatcaaaataaatagaaaagatcatcatatcttcacaattatggaaatgttaataactttacaaaataacaataaaattctcatatccgaagcaaccatttattttaattttttaattttaagctgccattggatgatcatcgcaatgtacaaatttcactagaaaaatacccttttatcctaaccaaataatctagcttgcacccaccattttgtagcaattcatcatacacaagttctgcagccacgtgcaggggatctcactagtaactctttggagttgtgttttcaagtgttcattaatttgtttggtacccctccatcccaaattataaggccattcccaatccattgactggtatgatatccatagcattaaataagctgcaatctaagatgaaaaaataatgtggcaagtgaataaacgagtaaagagaaggaaaccaggtcttacatgagacatggtttctacacaacatattagtattgacgaaataaaagccgtgtacagtggtggcaaaaaatcgatggatcctatccgactcagagcgattttttaatagacggtatttttttagcaccgttttttaaaatggcgcgttttttcttatagttttttcctcccatgttttttttaaaaaaattaccgacgttggaaataatttttctcacgtgttttttatttttttatggaagatggaaagccttttttagcattttttgcgctttttcctgacttttttctcacgcgtttttttgaatcattgttattttctcgtgcattttctctttttaaatcgtttttattttctcgtgcattttgaatcgtttatattttctttttacgcacctttcagcttttgttctctctcttttattattattttttaaaaaaacaacctcaagtaccttattgcaagattatagggactcaaatataaatataaaaattacagggactcaaatgtaaaagtacaaacctaaaaaataaaatcatataaaaatggaatgctctcgacctataggttccgtcttttatacagatctttaatccggcacatcattttgtttcaccaagatgtgtgagatatcacggtatagattaaaactgaaaggagtggtggctaatatctcggactcagaaggagtggctccttttatttttcgtttttaagggggaatcggatctatagtcggacctttttgtcgtttatgagaggaatcggataggagtcggactattttttttcgcttttttttctttcgccccgttttttttatcggacaattatttttggggaatcagacaaattcttttttcccccggtttttattttaccacgtcagatttgtttttttttcgcacgttttcttacccccggtttttttatcggacaattttggtttttttttttcgcccggtcttttttcgcccttttttctggttcggacagatttgcagatttgttttttcttttcttttttccgcacattttctttcacccggtttttttattagataatttacgtttttctttcgcctgtttttttagattggacaattttggttttttttcgcctcttttttctggatatttgtataaaatatataatttaaaaatgtattatgatcctatgataccatgatactgcagatctatcctatagctagtatctatactgattaccttggtgaaggggtgcctccacgccgccaaaggaatcgtggcagcagaaacgggggattgcctccttgcaatgtgtgtagggcagttggatttcgataatgatgatgacgaaagatattcggacgttataggatcgatccgatcgatactatggtactcccactatttactataagtcatttgactttttattagtcagattttgttaagcttaatcaaatttataaaaaatatataaatattgtcaatacaaaacaaacatattataaaaatatattcaatgtaaaatgtaatgaaactaattttatgttatagatgttgctaacttttttcataaacttggtcaaaataaaaaactttaactatgaaaaaaaaagtcaaataacttataatttgaaacagagtgaatactacaaatcagaaaacggcattagctaagtatctactccctccgtactcgaattagatgtcgttttggcatcgctcgcgttttcgcaaaggatgtcgctgtacgctcggaggaaaggaggtggacgtgtttgcccctgcgcatgcgtgctcgtcgtccgcagtaatcacgcgcattaatcgtgcctgttcgttaagctcgctgctcggactctgttcagcgaatcagcgctcgcatcgcctcgctgcgcacgcttgagttaatttcttcgtaggcgcatgctcgaagaaattattcgctgcgcggcttccttcctcgtcgcaggtcctcctcgcctcgcctcgcctcacagctcgccgctcgccgcacgtcctccttccttcctcgcgctcgcgttcctctcccgcagcacgctcgccatggagctcggcgccatgaagctcgctctagacatggaggagacgctggactcagaggtcgcactcgactcagagatgacgctgtgggactcagtcgagatggcgctggactccgtcaaggtggatctggactcagtcgaggtcgcactggactagagtgacgcctaagcaaaccttttttcaaatacctttgtatcctagctttgtttataccaagtttactagacacatcttctatggtcattctttacttgagaggaatgttgcgcaattgtttcaaatcaagagggattgccttatggccacatctacccttctttctacttgcaaccacaattggactgaccgaatgtgcaatccaaattgattagcaacaattcttgtatctgtattgcctagtgtcccattcttgcttttagccagcaatacttgatacacttgttttctgacttcttctgtcatttctttctttcgatggtttggttctagtaagaggaaaaaaaacaagcacattcaaaataatatccacggcttacctaaaaaacaatcatacatggaaagtacaaactgagaaaggaaataataaccacggcttaccagcgatgttttgtacgaaatcaaaatcaaatgcaccatattcatcttagtggtaagttcaaatcaaatcctgtcgaaaatgaaagaacacactgataatggaaactaatttgcatgagactgctgtgaatatcaaaaaacaaaactaatttcctcatactccaacggaaacaatgaaacaatgaaatgatgcattaccgttgccgtgctctgccgcaggttcgttgagatcgaacccaggaaataaatcggccatgtgcggatggctcagtacatgaacaagtgaggaagaggtggcgttaagaagtggcgtgtcttaaatagatcaagcaggagatgggagacccaagcgtcggtccagacagcgtgccgtgagcgcgccagtgaaaaccaaggcaaaaaaaaaaacgagcagcaacgcgccaaaaccgaatgccatgcaaatgagccaaactcgcccgctagcgaagggatttgaaccatatgcccacaggccttaaggcgcggctgcctaaccaatctagctacgaacaattcttgcacaaggaaacccacctgatcatttagagcaggtacaatagggctgacccatcagctccaataattgccacgtcacattatttctacgtggaagggtaatgattgaggggaaagagaagagctggcgactaaattgtcgccaagctataacgcattttttgggggcatagcgcccgcttgcagcgcatttagattggatgacatggggtaggtatgtcacaaggtgacatagtgtagatctcagtccttctaaataaatccagcggctgagattcgtccacgtcattacaagttaaaatttaactccaataaaattttaactcctgaaattttaactaccagtaaaatttttactcatacgagttaaattttaactcatgatgatgtgaacgaatctcagccgttggatttattttggagagctgagatctacgctatgtcaccttatgacatgtctatcctatctcacccaatctgaatccgcttgcagccgaggcaggcgcctaaaaacgcgggttgtggggcccacgaccggaaaaactgatatgtgcccgcaccgttcttaggccgcgatccactgatccgatcccctttccc

SEQ ID NO: 69559 - DNA, 11834 bp, Oryza sativa
  unsure (1)..(11834): unsure at all n locations
nnnnnnnnnnnnnnnnnnnnnnnnnnnnnnnnnnnnnnnnnnnnnnnnnnnnnnnncagccgaggcaggcgctagaaaacgcgggttgtggggcccacgaacggaaaaactgatcatgtgcgcgcaccgctcctaggccgccgatccactgatccgatcccctttcccctttctctttgccatgagatcgatccccctctccctcttggcgcgagcgcgagaaaggaggctggcgcatcgatctctccttcctggcgcatcgatcccctcccgccaaatcgatggacagatctcccacccaccgcatcgatcgatctccttcccgcgcagtattccctctcactcactcctttttcttctctcccggtcctataacttctcccgcgcgcgcgaaattcattttgctggcaggtagaacgatgccaaagccccaaaatcgcccctgaaatccatccccccggtgaatttcagggagggccactgccccccgtcctcttccatagttctaccgcaccaaaaccctagttccttttcaccatgtctcgtcggacgaagagagaggttgcaccaccgcaaactcatttgcaagctcgtctggtcctcccggtgttcatatcccgccggcaacaccgtatccatatggaggtcctttgttccccaccccactgccatcatggtttccttttccaccgtcacaagccatggcgggctcatctgcatatcgtcctcctactgatgccaagacggacgtccaagttgatttggaacaatggtacatttattatttggctttatcagttctgattttgacatgcttctgtttccctgtctaatattgagagtttcatggtcgttattgttttgatccataacagcactagtgcaatgaattgtttaggaaaaaagaggtgattttggtctgataatcaggttaccgtagtaacttggcccatgtaatttggtctgcaatgatttgtaccatgtatttatgcagcaatttggctaagtaaaaacaagagtccaatgttacatgtagggtaaccatggtagggtaattagcagtggtggtaaccatgtatttatgcagtaatttggcaaagtaaaaacaagagtccaatgttacatctattactaatttgttttagattcgagcactcatttaccactatgaactgaaataaaataattttgactgcacatatcaatataccatttatactggggtaatattgggttaggccttgcattgatcaagattggcttgttcattcctttttatatatgggacataactgatcaagattttcatgttcatgatttttatataggggactagaatctcgcccgctcggtggttttgttgattttatcaaaaacaccacgaaccttatgcaccatgtgactgaagggtgtcagttgcagccaattaatgttgagaatggcaacaatggaaatgccactaggaccgagaagcgcctaggctggtcaactgaagaagacttgaggctggtaagtgtcctacgcgagttatttatttggtagtggcattcataatacatgcaatttaacaatagtgaaatatttggaaattgtaggtcaggcttggttaaacaactcaaatgatccaatagaatcgaatttcaaaaagaatgataaatattggctgatgttgctgctgcttacaatagcactactccgtcaagccggtttagtaagatcaagaaaaaagttaggaatttttgttgcccttggaaggaggctaattcattatatgctagtggggagtgtaatgttgatctcatggacaaggcgctgaaaatgtatgagaatgacttcaaggatgggcgattcttgtttattgagtgttggaatgaactaaaaacccaacctaaatggcatgcatatttggatcagcttgacaagtcgaataaaaggaagcgagattatgctgatgctaccccccttgatgacgaggagatcccacgtccaatgggagtcaaggcagctaaggcgaagcgtataggcaaaggaaaaggcaaggttcaagattgtactgctgagctagaagatgacacccacaagtttatggaagcacatgaagcagccaaggagcagtaaagtgaattgttggagacccagcgacgtgttgctagtgataatcttgaagcgaagaaggtgggtcgccagaccgctatgattgcagcatatagagagttactgaacaaagacacaagagatatgcctgatgatgtgaggtctgagcttgttgcaatgttgaaatgcatgagagaagatatatttacaaaaaaccagtgaggtatgtgtcatgaagttctttgcagtagtaaaacatgcatatatctacgttgattttgagcagtagtcaaactattgtactgtattcatagctctagttccaaacaaccatgcaaccagtccctgttttgtgataattaatagcattcagtccaaataatcatgcatatagtctcatattttgtgctgattaactgccattagtctaaataaccatgcagtcaacccaaattttcatgattattgtagctggtctaaattaaattgcagtcaattgccaacccatattaaatttccatggttgttgcagctggtcctaattaaaatgcagtcatagtccagacatattaaatttttcatggttattgcagctggtcctaattaaaatgcagtcatagtccagccatattaaaatttgtatggttattacagctagtcctttgcagcatctatatattacctctcataacttgaaactgccaacccaatctatcctcctcctcctcctccaaccatgtcggactcatcctcctattcatcctctaactcagatgacctagacccatctaaagttctagacaagtacatttctgagcagaatgtactagactcatttgcttctcgaatcatagagaagatgaagggtaggttaggagctgggcgttcgaagcgccaaggtggaacaaggaagacaattcatagggatcatgtagatgcccacagccgtttggtggctgattattttgcagagcatccattgtacccagagtggatgtttcgcacaaggttccgcatgcacaagccactctttctacgtattgttgaagccttaggtcagtggtcaccatactttactcaaagggaagattgctctagccgcacaagtctctctccacctcaaaagtgcacagcagcacttcgtatgttagcatatggcacacctgctgatgcactagatgaatatttaaaaattggcaagagcacagccttagaatgcttagaaatgttttcacaaggggtgattgaggtatttggtgggacgtacttgagacgccccacaagggaggatgtagagcatatattacatgttaacgagtctcgtgggtttccgggtatgctaggtagtattgattgtatgcactggaggtgggaaagttgtctgagggcttggaagggtcaattcacccgtggtgattacaaagtcccaacaattatccttgaagcagttgcttcacacgacctatggatttggcatgccttctttggtgtcgctggttctaacaacgacatcaacgtgctgaatcagtcccctcttttccttgacacagtgagaggtgaggcttctcgggtccattattatgtcaacggggaagagtacaaccatgggtattacctagctgatggtatatatccagaatgggctgtattccagaagactataccacttccacaaactgagaagcataagttatatgctacacatcaagagggggcaaggaaagatgtggagcgggctttcggggtattgtaagctcgtttcaacatcgtacgtcgtccggcaaagaaatggaagagaaagagtgttggaaatatcatgctaacttgcgtgattctccacaatatgattgttgaagacgagggcgaggatgcaatatgtgacctagacctcaatagaattcctaggacatcaatagtactgcctccagaagtaaccagtggtggtaaccaatgttttcgtgatgtgctaagtaggaaagctactatttgtgctcgttcaatgcatacccagcttaaaactgatttaatttagcacatttggaaccggttcaggaatacgcagcgtacataaccatggtagggtaattagcatataatttcccccttttttgtcatatatagagccttttaatttacccttctatatgttttatttcaggaacaattaagctttgatgtctactgtgttgcacctctgcaacacacctcttacaggtatatttccatcatatggtatatttatcgtgtgagtactttcagctgtaatgaacatcgaaatttttgtgtacatgaaccgattttgttcctccatatgctatatatgttgtatacatgaactgctagcttcatcattgatcttttttacatctcagttcaaaaatatgattcatgaatccatgtaactatagtgtagggactgtgacaatctttcaagaaaatttattggaatgagacacacctaattttatagttttaggaaaagtttactgtaattggcagaaatttgaccatcactaagtagttagatttctgggattaatattgcatttgtactgtgattgttctgctgataacataatttatattctgcaacaaatcaagatggctgatgatggtccatatggagatcaagaactatctcagtttatatctatgttttcgttaactgttattttgttatccctaaaaagttgccttgtgtagcttattattgtctagtttttgtggtccttttgtttgatggcatgttgccaggagatttgtgaatcatcgtatctgtttcactgtttggattattaatcctctatttaactagctctgatgtgattgtgtatatgtggtgcaacaaaatggccacaaatatggatgtcaggactgatcccaacaactgctattggcatgcatgcattaaatagttcaatgtattaatctctgacattttacagctaatctattgtacttggtaagctataagctagctcttcctgagttggacagaaaattggagatggcagtgggctctctattgaccttgctcttacacggaagattaccccttaattaatgactccttagtaattactccctccgtttcgaaatgttcgacaccgttgactttttagcacatgtttgaccgttcgtcttattcaaaaacttttgtaaaatatgtaaaattatatgcctacataaaaatatatttaacaatgaatcaaatgatgggaaaaaattaataattacttaaattttttgaataagacgaacggtcaaacatatttaaaaaagtcaacggcgtcaaacatttcgaaacggagggagtataatcctgtccgaaatgtcatctaattcgagtacggagggagtataataattaccttggtcaggggctgcctcatgccgccaaaggaatcgtgggatcgcctcctcgcgatgtgtgttgggcagttggatttcgataacgatgatggcgaaagaaactcctacgttagagcaagtttaatagtatagccaatcgctagctccaatttatctatagccaatttaatagctcatttatacaatagttatatactacactattaatacctggtcccacctatcatacacacactgcgtcttggagtccgtgctacagctggctataaatctatagcccactgtccttctctctacttatttatcttccttaaggaaaagtacgttttacccccctgaactatttgggtcgttcgaattaccctcttagactctaaaaccagttattttacaccccaaaattttcaaaccggccaaattacccccctaagtcaatccggggtggttttggtttgacgtggcgcacacgtggcactagtttgattgatgtggcagtccaacatggaaataacaataataaaaatggtgggccctaccagtcaggcacctattctgattatacgagagagtgagagagggcagaaggggtgtgggcggcggagctcaaggctagaggccatggagagcggccgccggcgtggatctcatcgcaccggccaccgaatctctctcacctcctctctctcatcttcctctctctctaactcttcctctctctctcttgcgcgcggcagcaggcgggcggtgggcggcagcaggcgggcggcacggaggcgacggtctctcccgcgccatcgccaccgccaccgccaccgcggctatggtcgtacaccacccgcgggatggcttactccagctcggtgcagaggaggtcgccacccatgatgaggcccatgccgaacgcacggagggcggctcgtcagtcgtcgtgcagctgctcccacgccatctccctcgccgcctccggccgccgtcctcgactcctcgcccgccgcccgcagctgcctccaccccctccggccgcagctgcctccgcccccgcgccacagctgcctcctctgctcaccgagagagagagagggagagagaggcagagaagcgctacctctcggcgacgccatagcccgctgcccgccgagccgtcgtcggctccagctccccctctgccgccgccaaccgcccggccccgcgcgccgccatcccccgcacgccacacacacctgctcccgcatcgccgccgccgccgccgcccttcaccacggggtcgtcggtcgcccactccgcctccgcctcagccgctcgccacccgcagcagcgcagcccgggaagctccgcttccgctgccagccgcccgctccgcctccgcctcagcctcagtggcacgacgcccgccgcacagggacctccgcctccaccgtcgaccgcccgctctgcttccacctcagctgcccaccgcccaccgcccagggagctccgcctccgccgcccgctgctcggggagctccgtctccgtcgccggtcgcccgctctgcctcagacacccggccgcccgaggagctccatctccgccgccggtcacccgctgccttgcccgagcgcgtgcgtgagagagatggaatggttgagagattgccagattggtttgaggataggtatgacaggtgggccatgtttttttttattttttttgctggttagattgccacgttggcgccacgtgtgcaaggttaagtcaaaaccactcaaaacagtgttaaggggccttatttgtccggtttcaatagttgagggtatagaatgtctggtttttgagtttaagggtgtaattcggtcgaccgcgatagttcagggggtaaaacgtactttttcctcttcttaaattatggttgcagctggcttatagcctgctattatacctgctcttataggattcatccagttgagacaatgatactccctcttttcatttcatattataagtcgtttgactttttttaagttaaatatctttaaatttaatcaacattataaaaaaatataaaatattttccatacaaaacaaacatattatcaaaatatatttaatgtaaaatgtatggaaattaattttgtgttatggatattgctaatttttttataaacttgatcagatataacaaactttaactatgaaaaaaaatcaaatgacttataatacaaaatagagtaaatactacaaatcggaaaacgatactccctccatctacttttgatagtaatatttcatcttggcacacagaccaatgataagtgattgtacttgtcatccatttaaacatgctactagtcattcctcgtaaacaagcgattcattaatatttacatttcccgatgcccatgtagccaatcttgtgtgtaagaatggagagtcacgcattaaatccaagaaagccattaagattataagttgttggattgaaatatgcctatcaaaaataaaattttcaaatttagaaatatgactattaaaaagtagatggagggagtattagctaagtatctatactaattaccttgtcgggggccgcctccacaccgccgaaggaattgccgaagcggaatcgggggatcgcctccttagtccttactaagtgtgttgggcagttggatttcgataatgatgacgacgaaagaaattcctacattagagcaagtttaatggtatagccaactactagctccaaaatatttatagctaatctaatagtccattcatacaatagttgactataaaaatatactacccattaatactcagtcccacctctcatacacatataatatcttggagttcatgttacaactggcgacaaatctgtaatccgctttctctctcttcttttttcttcttgatatgtggttatagttggcttatagccttagctattgtacctactcttataggattgatcccgtcgatacatactccctctatttcagattagagcatgtacaataatagcaggctataaaccagctataaacacatttcgaagagataaaagagaagagagaagggcagtgggctacatatttgtagccagctgcagcacggactctaaggtacatgtgtgtataacaggtgggaccagatattaattatgtagtatatgtttatatgtaactattgtatgaattggtcattaagttaactacggatgatttgaaggcagcagatggctatactattaaacttgctcctaaggtccattcgaccgtgcatctgcgatcctcacgcgtgcaaacgtaattagcggtagcgtccaggattaattaggcaatgtatttagaaaacatccaactatctaattaattaaacttttgattttaatcccaaatatatagggcgattcgttataattcttttatcttaaaaaaatcggaaattttaatcctaaaattttgtcacctaaatacgttgccaaaatatgccacttattattttaggtatacttttttcattctagtaaaaagttggatagtaatttttttactattattgtaaaagtttctcaatataattttttatttatgtataaagtttatcaatcatttttttacatataaagtttataaatgaaaatattttatctacatagaaaatttatgaatctattttttttgtttatttataaagtatatcaacataaatgttttcttttatgtataaagtttattaatgaaaatattttatatatgtagaaattttatgaatataaatttttatttacatgcaaagtttatgatgattcatatataatttcaagtagatggagtttacaatttaagcttatttctatttgaaaatagaagtttcggaatctaacatatcaaaaatgttgataagaaggttttcgtatcaggatgcgtcttccctgtcccgataccctgttcctggcgacgtgtcatcttcttattcgctgggtcttttctggtgggccagtacgcatgcgctcctctttcacttaaacggcgtcaacgtcccgtgttatactatcacaattaatttggaaacaacgcaatttaagcgctaacaaaaatatggcgccaagcaaataaaattagtggcgggaaaaaggattagagcggtacataagtacaaatacacagttattttattttcatctacacagattgcgtctccacactaacaagaactctcccaaatcttggcaccatgctagatgaactcccgattcctagaccaatgccatcacaattgcagaatacagtaacatgcggtacgttcgcattcttggatgatacttctgccccatcatcatcatcatcaaatcctgctgagtccacatatccctctgatggcctgggaagaaatcaattagaagctgtaagatccctatatattctcctttacattttgttaaattagttgcatctaaactgtaagatccggacatgtgcacgtgcatatgaacaactatattcatcgttcctttttttttttttgcaattttttgatggaaactattaccacagataaaactaggatgaaggaacaaatgaagcttctcatacaataaaatatctggaagacttggtgccaaagattggcatgaaatttagctctgaacaaaaagcttatcgacttctacaatgattatcttaagaaaggtttcagcattagaagaagcagctatcattacatgggaaatactaaaattataaaaaacatgacattttgttgttctcgtcaaggtaaattctttgtttctttttatagttacattaactttcaattagagacattttgtttcaattagtgcactgtattaacaggaagtagaggtactgacaaaagagcagaagcttcaggctatggcgatagttatagtaggccagaaactcgatgcaagtgtcaagcatgtatgaagataagtctcatagatggattctattctatctatcactttgtgcctgaacataaccataatcttgccactagaagtcaggctcatcagttacgatcacaaaggaagattaatgaagctcaagttgcaagcgttgaagtcgcaaaatccgtagggatttctactaaagcagctattgatttgatggcaaaacaagcttgtggatttgagaatctcgggtttactcgtgttgacatgaagaataaattatactccaagaggtccctacaaaccaaacaaggtgatactggaggagtgttagaatatatggagaagaaagcatcagaagatgtcaagtttttttattctattcaggttgatgaggatgacttaattacaaacattttctgtgctgactctaaaatggttgccgactatgaaaattctggtgatgttgtatgctttgacacaacatatagaaagttggatgacggacgaccttttggtttgcttgtaggagtgaataatcataagaagactactgtttttggtgctgctcttctatatgatgagaccgctaatagttttgtttggttatttaaaacttttctaaatattatgtcaggaaagaagccaaaaacaattttgacagatgaagatggagctatggctaaagcaattaaaatagttcttccagaaactcatcatcggatatgtgtatggcacatgaatcagaatgcctgcaagcaccttgctgggtgtgttaaggactataagaaatttaatgctgactttcagaactgcatatatgatcaggaagaggaagaagaatttttacgtgcatggggccaattgcttgaaaaatatgagcaccagcaaaatacatggttgtaacggatttttaagaaaagggagcaatgggcattaatatatggccagaacatgttttctgcggatatgagtaccacccaaagaaatgaaagcccgaataatgaattaaagggttatattagtgtgaagtatggcatgctttcttttcttgagcactttgacagattggtgggagataaaagatatgaagaggtaaagtgtgactttagagcaacacaaagtacaccgaagctaaaggcagagttgagaattttgagagatgtagcagaagtttatactccagcagtttataagatatttgaggaagaggtaatgcagactttgaattgtgacatattctactgtggtgaggttgatgcagaaaaggtgtacaaaataaaggccaacggtaaatgcatcttgaacatgttcatcttgaacatgttgttagatactctccgttggaatccaatgttaaatgcagttgcaagaagtttgaatttgctggcatcttgtgctctcatgcactgaagatacttgacgtcaacaacatcaaatcagttcctcaacaatactacctccgttttttaa

SEQ ID NO: 69560 - DNA, 3442 bp, Oryza sativa
aaccatgcatcagctccaactcagcggcaaggcgcttgatcagtgttgggagctcgagacaatagactgctcggcaacggtgctcgagctcacccgtaaatcggcggaatctgacggagttcatctaagtcaaggtggggaatttttattttgttgtactaatagtagatcatccgcatggagagaaaggaattaataatgtatatgataccttctgttgggggagggaagggatatgttacgccgttgtgggaaaaaagaacggagacgttgacgccgtttaagtgaaagagaagcgcatgcgtactggcctaccagaaaaaactcggcgaatgagaagatgacacgtcgccaggaacaagcgtatcgggacagggaagccgcacccatatcaaatactagaaaatttcactttatctttggaattttttcagtataatagaatgaatgtattttcttaatatttagtaaagcagcctaactgtaatcacgcgaaaccctcaaactgatcgcacgctttaatttgcatgtatgcagaagttcttttggtcctcaaactatttaggcgcatatgcatgcgcattaatttgttttttcctggattaactggtcaatagccgtggtaattaaacatcaaaatataattatcggcgtgcaggctgaaagtgtactcgcggcagtagaaattaacatgcgaatgcgcctacgttatagggatagatggattgaccagatcgatccagtcgattatcccggctgctgaaaagggccgctcctgcattctcattagatagccgatcctccctataaatataggtacatccacactcattagcatcacaaagtagctagatttcattcctagctagagtgcatttagggttatatcgatctaatcatttctcccttgccaattaagtctccatcgatcggtaaatcagctatggaagcgagaaaagccagtgttgtttgctgcatcttactgcttgtgttagcacttggaggtcctgcttctgccacaggttcatcttaattctccctcaacccatttgatttcatctttcgaagaaactgcatgcgttctatatgctctgaattttatttgttttcttgagcggttctctatagatatctgtcagtgatgagattataggggacagtttacaattaatgtttcatgtgatttaataaatgataagctagattattttataagctagcatctaatgagttctttctctttgtagattattgctacaaagccattggcaagctgatcgtctgcgtgggtcctacgtgcaagttggactgttggcttgaggcgaaatacaataaaggcagagtcaagcgtcacaagtgcatgaaacatggcatatttgccaaatgttactgcgaaatctgtgttacattttgagggaatcgatcgacaatttgtaaaagtctttagttgatttagtctcgtgtaataatctagtacgttgtttgctagctagtttcttttataattgattagttttgggagttgcttttgtttggatataggatatgtgattatttaatttcttcctccaatgtatcagttatcactgtactctcattcaagattttttttaaaataaagtataagtgataattgcattataattttaattaactaagatatcctcatcgtttggcatattcatatgcttatcagccaaaatttgaattttcaacgttaaatttggagctgattttggggttttttcatcaaagtttatttttcagcctttgcttttagatcactaagaacacaatataaaagttttattcacaaattacttttcgtttgcaaatatgccatttggcttattccaccaatataccaaacgatggcaccctaacattctatgaaatgtaattttgtgagacatatatatgcctcttaacaaatgtagcatatatagcgtttgtcaacacaagtaaactgaattacaattattcttcttcccttacgtttgacatacctctatttcacagtattacaatattaacatcggcctttatcacgatcattaaaagtttgtgaaatgtaatcctgtaaattgtaccttacatttgacataacactaattttgttgatctcattgatcatgcctcgtagccacacaaacagtgtgcagatttgcagtgtagtgataaaattgctcgctactgatcgaaatttgcaacatgataggctaaagttgtaacaaaattacggttttaacgaaatggctacatttgtatgaaatttcactgagaaaaagaatctcaatggactgcgcttatactctcaaacctgtggtgagtgattgctttttctcttggtggtaaagcacgataatttaattagttattcgaaataaaaagtataacaatgcaagggccagattgcgattgttgtgctatcctgtgattatttttttcatctgccacggaagaagtagttgtggaacttaatcagtaactctgtctggcagatcacattaaaatctaacaaggtaaggcgaggaaggttaagaacaactacatctgcatgcatgcaaagcctgttgaccaaagtgattttaaatgtgaattttaccgatctttacaaacatcaagtcagatagtcaaacggtaaaatactacgactaaaaagtggtttcaccaccaggattgttcaccggaatactaaacatgccttgatagagatgaaagagcgagagatgataataaaattattatttttgttattttaattcatggcaatgaatttttgtccgtagtgcgccatacgaacgtgtcagaattataatacctccgttctgtaattgaaatactagaagcttattatgaacagtatctcaaagaatttgatattaaagggagttaccatggtaaccgtataaaaccgtgtaaaatccgtcttcaaatatttgaattcaaaaatcaacggtttcagcgtggtttctcgcggtaaccgcaatatttgcgcagttatcgtcaagtgtctagcaaaaaattgaaaaatcacttaaatgtgtctagaaattgggtataaataaaagaatatataggatatttgtaaacctaacttttaggtgtaaaatacaaaaattcagcataacattttctatattatggatttcgaagcaattcaacaacaatctaatgtactttcggtttcgctctcaaatttgaacttatcttactccttttcaaaacatttcttcaccatctaccactacaaatcaagaactatatccataatttttttcggaattttgaatttgggtataatttatcaaaccctactgccggtaacccttacggtacccctgatcacgatcaatacaattaacaaagaaattaatagcatgttcaaacacaaatacactgcgtatattcgataaactggtggcgctgggctctagctagc

SEQ ID NO: 69561 - DNA, 13816 bp, Oryza sativa
aaaaaactgagaaaaaaaataaaacatctatccatcgattttcacttaaatcggtgggtccaatattataaaccgttagattagatctcttaaaacaaacagatgacccaccaacctcctcctcccttacatatctcactattccttccttccgttcagtatgaacgtacgtacgtatttgaccttcttttttttctttttccatgtatgtatatgagacaataataattattatcagtgataataaattttaaataatagttaccttacgagcattcaatatatcagcatagaactcttcacaaacatatatagataaattagctctataatacttgaaaataaagtttagacccattatattatattatgtgcccattattttagactacatttattaataaaagtatttttccatcaattttcacttaaattggtagacatattatttagaccataaaatctatcttttgttagaaaaacaaagcctccaatcctaaaagtttgagaaaaaaaataacatcctgctaataatcactcctcctgatcaatccggcaaatcactcatccgatctctaatacgtaaatacatactccctccgtttcaaaatgtttcataccgttgactttttagcacatgtttgaccgttcatcttattaaataaatttgtaaaatatgtaaaactatatgtgtatattaaagtatatttaacaatgaatcaaatgatatgaaaagaacaaataattacataaattttttgaataagacgaatggtcaaacacgtactaaaaagttaacgatgtcaaacattttaaaacggagggagtagttcgtatgtacgtgttgtgtgtcaaaaaagattaatacgttcggccgacaaattctctcattggattattatattaaaaaggctaattcaaaagttgtattcctggcaattaaaccaacaattttaatacccgcatatgttgtgaaaaagactaacatgttaacttagattattgctcttttttacaccatccaattactcataaaagtatacaaaacaaaatttaccgtgtagattattaagtatagaacttcataaatatgcatagccaaaataacaacaatgaaaaaccatgtatattttgaaaaaaagacatgcggacctatactttgcttttgtgtaccatcaaagagcctcaattatataataaaagtctattaaacttctatgaactatgctctaataaattagggaaaatcctagaaagtctaaaaaacacaaacatctatcagatatagcaaattgtttaaatcactttacaaacaagcataactcaattagctttaccgcattttaaaacaaagtttacataattatattatttaccattaaattaataatttattatgtatatttactatatttcaacttgtaaagggaaattatattttagatagcatttttattcctttcatgtaatccaatgcaaacggatatgaaaattatggaaaatatgacaatataaattatatcactatatatcggttatcagttcacaaatcttggtactttgcatggcattggagatttgacaaatcatgaaaaaaaataatggatgtagattatatcatcgtataagtatgcttatatatagggtccatactattgatccatatataccgggataacctataatgtatcaatcatatttaccactaccattgttatacgttttagagactatattaatcctctaaataataacaaaataatagacgaagtacaagccatgttttctctctctttgctttctattaagtacgcatggtatatgggaacttcatactaagactgtgttcgggaggaggggcacgcaaatcaaagcttgtattattgcatgattaattaagtattaactattttttaaaaaaaagattaatataattttttaaaacaactttcatatagaaagtttttgcataaatcacaccgtttagcagtttgaaaaacgtgcgcacggaaaacgaaagagatgggttgggaaaacgggaggaagaacacagccttaagattggtttattagggaaatcatactaaacttatttatgagagtgcatgcagtaaaacatacttgataaaaagaattgatcgaacaaaactgcaatttagcccatggcacttaaacctttataaacgctttacacatactaattaaatttatatgattgtgctattctttcaaatcaattttatttttcaaagaaaataagaaaacatatgaaaaaaaaagagaagagagtagaagtaaattaatagaagtttttttaattagatgaaacattcctattagccatattgtttaatagaaaatatattcacttaatatatcctaacattcataaatatatatggtataaaagcaattttgttacttaaagcatagaaacataaaaaaaactctaaaaaaagataagatatgctaaatattaaaaagtaaatacacatagtacaaacgatagttttataagaacaaactccattattatgacaacatattttctcatagtttcaaaacagcgtagttccaattaattttaatttagaatttaaacttccaagggtaaatataagaaaatcataaccaaaattcaaagcaatccaaaacaaattagtgaaaaaacacgtttacaatagtgtcaaagaataattttaagaaaagtcacccacataaaacattcttaacacaatttaaaacaacatcagataagatgcccgcgcatgtgcgcgggctatcttcctagttacatcaaaagtgctctatacttggggcataaagccagtactccactgcaattctgactacgtagaacgttgcatgttacaactgaagatcgtataaacatgatttaattatctcaatctcatctcatgaagaagccacagctaaagttccaaccttacagtctagattcatagctctccacaaaagaacgactaacctatagcacatatggcaaaaaatggaggtacacacaatacatttaatgcgacaaaagttgcgctatactcgtatgaatgacaaaatactgacaacggatgcagggtaaggcggcaccatagaaatcacagtacctatctgactttcttcaagagctctaccttctcaaactctggggccgcataactcttctctacttcccacgcatgatgagacatcatgttgaatgatgatttcactcccttctcatcagagacctctctcgtgaaagggatccgggcagcaaaggtactttccccggaatgaacatgcaagtcaaaacccaacctgtctacccaaatcatcttcacctctgtcgcctgtcaccataaaagaacactgttagcacattcagtaaacataacggaactcaacacttggtgcggtatataatatctcactatctatgaattatcacatagcacataaaatattaatcagctggagtatcttttagaaaagataagatcaacaattttttaattacttttcttcaaataaagaataaaaagatgcatagtttgatatgcccctaactcatatatataacacataatcactataccactatcagactatcagtaaattacatctttctgttttggtaattctctatagctatgttcccatcaaaaaaaaaaaatctctacagctgtgtgattataaagaaactatgaaaagacaaacatgtgctttatcttaacattagctatttttcctttcaagaagtaagaagcaaagttgtaggaatgacaggaataacttcagtacctggaaatctgattcaacataaatactgtatatcctatgtacatcttcagcatgtttgctgttcatttcctcaacaatgctttccgcaaaatttcgaagagggtcaggttctgcatcactgtattctgatggaattacccacatgccatcctgaacagaaaaagtatcccatgaatatcagtctcatttgaactacaaagttctaaggtgtaattggctcaccagcacacatccatcagaaaataaaaactgcacaactcacatagaactaagtacatcaaatgcaacagatgaaacttgacaacatttaaagcacctaatatgttggttgaacaaatttcagcagctgctcaaggttcaattagcaacctatatcaattcatttccgtagtaatttggtcgtgtggaagtgattcaatgagtggggaataaactaaatataggtgtgggggaaaattgataaattgatgattttattaagtgctaaaatatcttgatgtttttttttctaaagtcaggaagctatccatgaaaggaaattgagaaagacattctactaaaagtgatctccatatatttatcctcgtaaaatacaggtcagccaaacaaaatctgaataatgtaaacaataaataggtcttcttccgaatatgaaagaaggcaaaaccagttataacaaaaaaagaaggccagacactttcaaggggtgcactacacctgaaacacagaaatgataactagaccaatacagccaaggtaatgaaatggatgttccaactgaaaatattcttaggatagaatgtaaaagttatcttgctccatgcttttaatgtacattttcacgttaagaggctattttcgtcagctagtttactgatcaccattcagcgtcatggataactatttgataccgttctgcacagcaatcttcagcgagtaaaaagaaattcaacccacatctcttgtctacatatcttgttactgtctcacactatgcaaaaaatcatgcacaaataacccatacctaactattatatccttattattagcaaaacagaatgaagtgtgaagaacactaaaagttccatctcattttctcatgaaaatgagacaccttctacttcctccgtcccaaaataagttcatttttcacccaatacggtagataaagtaaggaatgtttgtatagaagtagataaagtgaggcaatcaatgcggaacaaacactgcagtactagaataagaactcccaaaatgacaaactgcagaatatgaagaaaccaaaagtaactagaagaaaataatgtattttacctcattgaaatcttcaatgtgcaagattctgtctactgatatcaaatacaaaagatcttgatctatctcctcgccaaatttcttttgccacctagtagaaagcttctgcataattcaatttagcacattacgaatcagtaatccgacttagtatatcatgctattcttctgcagtacatagtttcccattgtaatcaacttacaattcacaagtgtaatgcaaatatgccttgaacaaaatgaaaaaccataaaaaaaagtttacctttaattcatattcatcgttaggtttagtcaaagcaccaagcaaagtacattgaggtgtcctggccccactctgacgaaactacaccacaaaaggtagcgagaatggtgagtacaagatacaaaacagttgtgctagtgctcacattgtcagcattagaatttagtcatcaatgattctacacagagttcacagtgtcggcgcatcaactaggtaattaaagtgttcacctttgttacaagcacctgtcttccacaaaaccaaaatgcatttaacatagtggagagatctgacatcttaagatgtctagactctagaactttccaatttccaaacaacacaagtacacaagaatgcaaaccacaaactaaacaactgcaaaggcaacgcacaatgcaaagcttcagcaatgaaattctcctgcgtgatgtaagagtccagcggccttctaactcaaattctacacgaacagtgcacaaaatcattacagcgcctcgaatttccgtcttaatctcacgcaaaacaaaacagtgaagtcaaaacgcgagcaatccgtaaaattctatcccccacgcaacagtaaacagcctaagaaatcaatcaatcaatccatgagcacggctgcatccccctcacctcgacgtggaagctggacggcgcatcgggcgcggcggcggcgggcccggaggcggcgaggcacagagcgggcgcgccggagccgtcggcgacgaagcgggcgccgacgccgagcggccagccgtcggggccgaccacggagagcgtccccgacggcgcaagctccaccaccgtccgcgccacctcggccgccgacggccgggacgcccgctgctgcgcctgcacgggcgtcgcgggcgcgggcgcggacgccgccgccgcagccacggcccgctcggccccgcgcctcccggcggcgagcggcgggaggcgcagggaggaggggttggtggagaggaggatgggcggagatgggagcggggaggggaggagggaggagggaggcggcgacatggtggtgatggaaatggaggtggaggttgtgattcgtttggagatttgggaggcgggtgagattagaggagataggcagggatgaaagcggatcggatacggatcggaaactagctttatcatattcgttttcatattttttttaagaatcagaatcgaaatcgaaaactcggatacggaaatgaaatcgaatattatcgaatacagatacggagcgaatacgagacggaacgaatacggtagcggatatttaccggtatataaaaaacccctcaaattgagtttcttgatcaagaaaaagatatcgcttattattttagttcaacatctccaacatttatatcgtcaattttatagacggtcccacaaccctatgtgaaaatcaatttttatggctattcctcttagagatccatatgcaaatatgattaccattttctattctcacgacctttttactagatgtataacttacttactattgtataaattagagatgttatttattttacttcacatcttcgaaacttgtaatgtttgttttatactttaaatgctttcaaatacaaatgttataaactacaaagtgttagatctcgttgagctctacaactttgattctccatcagatgtcgtttgaattgtagatctaagattttgtaaaaattaatatggtatattataatgaatatttagactccttaaatgacctcaaataataaaatagtcaataagaaagttgtagatctcatcgagctctacaatgttgatataaagtttgtcgccatctgattccgtatgaaaaagttacgtatatatacatattttttctaaactttgctcaatgtttgcggatatccgaaaaaaaatccggatagtttccgaccgttttccgattccgacggatagtacccttactgtattcgttttcgtttccgagaaaaaaaatccgaattcgtttccgaatccgagaatttctggatagttccgaccgaaactatccgaatccgaaaaatggtccggacggacggaaattatccgaaccactttcacccctagagataggtgtggcattcgtagtcaaaatgtgttcttgatgattcggatttatggttaagtggttcatgctattaaaaaatctataacctacgtctagaaaaataataacttgaatctagataaatgcttggccagattcatcctaagaagttatttttttataggacggagagagtagataagtactcatgtattagctgcgagataattgtacgatagaataatattttctctaggtgcgttcacatgggcatagtcttttaaaactaattcttaactttaaatttcttatataatctcttttctactattataaaaattgaggatgtttccgttgatattttggtatgtcgtccgtatttgagtcggattctaaattcgttcgcttttgaaaatacataagaagttatataaaaaaatattttaaaaaaaactcacatactcacctaggatgagagtcagactcctaattgctttaaaatttctaccaagctataagaaaacaatatataggttatggccatcatcccaactagggatccgaattggatataaataatatctcaaaataaaattcatatatattttttagaaaaaaatctaacaataacacaactaaaatagccttcaccctttataatgcacgggcatgttttctagtatactacattatgtagcaatagaattacaataatataaaaataaatttaaatgataatccaataatattattttacatgaaataaaatttaatttataataaaatatttattggtcagttgaattttaaaatacgtgtggtcatagtgagtgaacagaggaaataaatttttcttgcttaatgtacgattttttttcacgtgcttttctgtatcttgtaatatgggttgattttgttttatgggctttctatatattatacattgatcaattatgtaaatggtataaatgattggagtgcatggtgtggttttatggagaaagatataatccataccattgatgaattattcaaatgcaaaaaataattgagatgatgacgacatccttcatcgaatccgcatgtaacttcacaagttccaatgactaagttcaagtcagtagcattgatttcaaatggatctagcgtcttcatgccaactctaatttggatgatgttggatttgttggagatcttatctcatcacctttcaaacgtatccagtctaatatcaaaattcatctcgagtcaataggaaattgggaatcgtcaaaacacaacaatgttgttgctgaaaccgaacttagcccttgtgctttgtaatagactagggccatctcggaagtgcctctctccacctctacgaaccaacacctatctctagctttattttcctctataaatagcttcgtacaccctaaaaaacaattgggttttgttttgttgaattttaccaagtgccattcacctaatatttaatccttgctcgattagtcggcatctagagatagagattcagagtcacccaatagtttatgcattgatttgctaggtcgattagatctaccatttcaatcacaactattcttttatacttaattacctattcgaaatatttggattgcatcttatcttgttcttgaagtgttctctcgtttacattgcagggaacatcaaccgcacatcacggttggtacaatatcgtttgtggtgttgcgattgcacagcgttctgaacttgttctagttggtagccacgtcgcaaacatcacagccaatcaaaatgagagttatcccctcaccagaagatcaggccacaagagagaccacaatcacctctcctaaccctagtgactataataaaaaagataccggaaacggttaggaagctccctcaccattttcaccccagtccccctcttcctctccaattgcaggcctaaaaagcaagagaaaattcgatccatagcacatgaaaaaactggtaccaaaaaatagcaaaaaaaattcctctttcaaccataagcacacgccactattttttcttcgatttatagcacttctgtcacatttatcgtccaagtccattggttagcgatgattaggagcgtgaaaagacgaatttacccttttttctaaccaaagtatgggtggatgaggtggccggaggaggcgcaggccttggtggcggcggtggggtggttgatagcgatggccctcgcatcccgccaccacagtcccaatccctaagcttgtccggcgccgtcgtcactaccatccccaagctctgccgttgccatccccaccccgagctcgttcggcgccgtctccatgctcgcgtcctattgccgccgccatcgcattccaccactaaacagccatgcccaagctcgtgtcctattgttgccgcagtcgtcttcaagctcgtgttcctctgccgccatcgtcgcccctgggttcgtgtccaggcgccaccatggtcacccccgatctcgcgtttcgttgccaccaccgtcgcccctgggttcacgttccaccaccgaaccgccatccccacgaactcgccacgcgcagccgccatccccgtcagaggcgctcagccgtgccacaccatggctggccaccgacgtggtggcgagatcgacgggacaaagagaaggggaaagatggaatagaagaaggtgacgggagtgctacaaatcgaaggaaaatcagaggcatgtgctttgagctaaaaggggaaaatttttgtgctattattttgttccggtttttctttttgtgtgccatgaatcgaattttctctaaaagcaatggaactgagcctaccaaaggcccagaatgtagtaaatatggcctacagttgcgtgggattccggcccgttgatctgcgtagttgtagggaatttcagcccatttgtctcatcaaattcagtccataagcgcgcgtgattctagcccgtcaatctgccaaatttcagcccatctaaaagtcagcagagaagtccaattttgaggaatatcaatcaaatttgaaaatatttcaaagagaactaaattacaatatgacattatgaccacacgctgagcacctaaattctatttgctctaataggacatacttgatatggagtatgattttccctactgaatattttttcttatttaactctaattttccatgctattttttaaaaacttgctggtgaagctggtagcctgatggaccgctttcggtcgaaaagaaatagtaataagttaaaaaaatcaaattaccctgaactactccaataaggagcctcctgtctacagcaccatatatatacctcatgtatgttttttttagataatggaataaacatcccgacctttactcaagagagctacaacccattattataatctagcactccacatcgagtgtagtccaactaagacagcaaacatcacggaaagataaaaacgaaccaataaaagataaagagaatacattattgaagtctatttatgaatcttcacccataattggcaaaaagctgcataagccgtcgactcaaacttgtggcatgcaacttttaggacctcttcatcttcgtcacatctttgcaatgtgcccaacaccggagccaacatgttgcacctcatatatgtaaatagaagtactataaaaaagacacggatgaaaattgtggcatagctatccaacatataacagcacccactaccttcacgccctttgaacattttttttacttaggttttttttctggtttttcgaggatatctcggtgtgtatatgatgcagtatcggacggacaactccctctcggtgtagtataagataaactcactttcaagacttatctcaccaaagtcatttggtttagaagacccacccccaaaacaagtaaatatgagatgcaatgcagtatatattcacacaataaattgtccaggctggaaagcatcagtttaatttatttttagataatggaatataatatcccggcctttactcaaaaaagctacagccaattattacatagtagttttcatgaacatagtgtaaatctaaatgaatagaacacaccgaagagaaaaacaaagaaaccagcctaacgtaaggagatcacaattattgaagtctatttgtaaatctccaaccataattggtaaaaagttgtataaccgtggtctccaactttcggcatgcaactttcagaaactcttcatattcatcacacctttgtagttgtgcccaaaaccggagccaatgagttgccctgaaaatgacctgcatatagaaaaatgatggtgatttgtcaaaaaccatatcgttcctactcagccatattgcccaacaaatggcagaagctccaataagtatcagtttactcattttcttatcaactcccaaaagccacctattaaaaatatgagatatgctaactggaagattaaaaccaaaagagaactgaacagctctccatagaaacttcgcaaaatgacaatccattaaagagatgttgaatagactcattcttcaaacaaaaagaacaactcaagctgccattccagttacgccttgccaaattatccttagttaacacaacccctttaagcaggtaccacataaaaattttaatcttaagtggcaacttaagcttccaaatacacttgtttctctcgatatagccattattaattaaagctaggtacatagacctcaccgagaacaagccattctgatgaaaattccatctaaaactatcagacgaatcattcaactgaatatgtactatagaggcacaaaactcatgccaacaaacaagattctgaccaactaaagctctcctaaaagaaacattaagcggaacagatcccataacagtggcaatagaagatgtcttcctccgaacaattgcgtacaaagatggatatttatccttaaaagccaagttaccaatccatctatctttccaaaatctaatttgttccccattgttgacaatccaagaacccatatttaagaaagtacttttgacattcataacactagaccaaaaatgggaatcatcttgtttcttgtcaacttgggttatagatttattataaagatattttctcttcaataaatcatgccaaaccccttcctcattaattaacttaaacaatcatttacttaaaagacatttattttgtatctccaaattatgaatcccaagacccccttggtccttaggttgacaaacaacattccacctagtgagcctgtattttttcttatggtcatccccttgccaaaaaaaaccgcgatctataataatcaattttacgaagaacccctttcggcacctaaaaaaagatatcataaacatggctaaacttgaaagaacagaattaatcaacaccagcctaccaccaacagataaatgcttggctttccaactactaagctttttcttaattctctcttctataagtttccaatatttattagaaagcttcctaaaatgcatcggaattccaaggtatttaaaaggaaaggtacctaacttacaacaaaaatatcagaatattgttcataacattcctttgcctgactaaagcaaaataattcactcttgtgaaaatttatttttaggccagataacttttcaaataccgataaaatcagtttcaaattctttgcttgttgcaagtcatgctccaaaaagatgatagtatcatctgcgtattgcaagatagacaaactatcatcaacaagatgatgaataaccccactcaagagtcccgcctctttagccctcttaatcaatagagtaagcatgtcagctactatattaaaaagaataggagataaaggatccccttgcctaagacctttgtaagtttgaaaaccattaccaatttgatcgttaacttttataccaacatgaccaccttgaacaaaagaagctatccactcacaccatctaggagaaaagcctttcattctcaaagtttgttgtacaaaaggccatttaactttatcataagatttctcaaaatcaatcttaaaaattacaccacttttatctttgcgatgtaattcatgtaaaataaccaccccttccctaatatttctcccaggaatgaacgctgtttgagtaggactaattaccttttgagcgtcatccattattttatttgtagcaactttggtaaaaatcttaaagctaacattaagtaggcatataggtctatgcctacttactcatatatgtgcacgcatagtagtgatacgcgcgtgtgcatatatatacatgtgtttcatgtaatgttaaatgtccggcctgtgttatgtattaggttatgttggagtagttttgt

SEQ ID NO: 69562 - DNA, 720 bp, Oryza sativa
  unsure (1)..(720): unsure at all n locations
tacccatgaattcagaaccccatagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagtnggnagctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagatt

SEQ ID NO: 69563 - DNA, 45357 bp, Oryza sativa
  unsure (1)..(45357): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacttttgaaccactataagtgaaaatatatactttctccgtttcatattacaagactttctagcgtcatccatattcatatataactagattcattaacatctatataaatgtgggcaatgctaaaaagtcttataacctgaaacggagagagtattttttatcctaaaattactttctccttctataacgtctctttagttctctggcttacaagtgggcctgatcagctatggtagccactacagtacattgcatgctgctgcacggtcgattggttgatcagaggacccacgaaaagaaaaacaataagaggattttttttctctagaaattggttaatttttccgtaaccgaaaagactttgacttagaaaaggagggctaaaggcaacgtgtatccatgattgactatttcacgatggtgaatgctggagcctggagtacatctgccagagtgccaggcacacactgcgtttgagaatactgatctcaggcagtcaggctcaacacccctcaaggaaaagtattagttaaactcaggacattaacgacctttcaggccatttctgttgcttgaagccgtagttattttcgctaatgaaacctctcttgcttcaagccatcggagtaacacgctgattacgtgatgacttgcctgagaccctctttacataggactaaaaacttttaagtccctatcacatcggatgtttggacactaattataaatgttaaatgtaaactattaataaaacctattcataatctgggactaattcgcgagacgaatctattaaacctaattaatctatgattagcctatatgatgctacagtaaacattctctaattatggattaattaggcttaaaaatttaaattaacttttatttatataattagttttgtaaatagtctatatttaatactctaaattagtgtctaaatatagagactaaatttaaatcatgtatccaaacaccacccaaagcggaacgagcaagcaattttctatacgaagggtacgtctgcctgccgcctgtggccggcttggcttgccgccacggtttccttgtcgaacgcgttgccatgtccaagtctaatttattaatagtagtatcgatcaaagctgttcctttgcaccaaataattcacccctctcagcgtgtccatacgacgatttgtcaaccaaatgaccgtttcgcaccgagacacaactctatcgctcttcgtctgaaaagagaggcgtcctggctacacagccttttacatttctagtcgtttttttttctcatgagctgcgtttgtgggaggtgagtttgtttgttttgttttcacgtgcacgctttccgaactactaaacgtgtttttctaaaaaaatttctataaaaaatttactttaaaaatcatattaatatatttttaaagtttaaaataattaatatttaattaatcatacactaatggctcttctcgttttgggtatcttctcaatcttctcttttcctcctctcaaacttgatgtttaactatttgcttttcctatgccaataacttgtgaatcgtttatgtatgtatgacatatgaatccaatggtatatgctccctccgccaaaaaaaaaatgaatctaggactgtatgagatatattctagtacaataaatctgggcatatgcatgtctagattcatattactaggatatatcaaatccagtaatgtgttggttttttatggaacagaggaagtagttaattatcatgtctaaaagtagcaaatagttaaggcttgttaactttgttatccaaattaaccatactggattttgatagattttggcattattaaattttggtagcattggctttatttgatttgatacatttatcaaaatttggtaggcttttaaaagagaaaactactaaaactaccaaattttgctaaggttataatgattgaagtatgtttagtttgttgctctattaaaatttgataatactaaaattttataaggttaaaattggcattgtggcaacatgaccttaagggccattttggtttgatttaaaaaacatatcttaccaatttattagcaaatttaatagtatgtgtgttactttggattgagatcaaatatttgggagtactatatttagtcatattctaaaagtttcttcactatactatcagaatttggctttatattggcagcaattcaaatattaactaaataattttaccctaccaacatttttttaatagtatgccaaatttacatagtctttaaattatctccctgcgggaccgttgatggagacgctcgcgacgtgtacgttaaccctcccagatacggagcaccgagagcatcttgtcacggtgtgtctcattgcacgtattaatagccggttcgtgcacagccacagcccgcaacacaccagttgtcgagttgccccgacgaaggaagctaggggttatttggatggtgaccatactttgccacaactttggcaagctactttgagcacatatttatcataccacactttttaattttgtgaacacacttatcataggtatatatctttgccaacatttgtctaacttgtgaccaagaatttcttagccacataaattgtggcatgccacatcttagttagagaagtttggtaaactgaaacaaaaatccaaacagcccctaaatccaccaccgcaccaccacccgtctccgcgcgcgggacggcgacgtcggcatcgcgcgtcgccgcgtccgcttgtgcgtggactccaccgcacgcatccgcaccggtgagaaaaactgggaacgcaacgcgtggcgcagacgcgtgcgcgggtcgatcgtgcgcccggtgggttttccggggaaattggggcgcgagctactctcaggttgcagctggtgcgggctggatcggagtaaagcctctgtccagtgatggagtgagtggtgactgctgttactcgatcggccagcgaacgaaccagccggccgcctagcctaagatggcacgatcagcaataactgctgtcctaacctggggggtgacttgtgggagtgtgaggccaaatctgtgctttattttccactaataaataaataatacgggtcgagttgggtgcgttttgtggtggtttctttgcgttgctttttggactagttcagtgtggtttaccctggtccggtcctgggctacaggccagcaagtccagcagagcttaggggtgtcaagcaccacaaaaaagttgaatttagccgttaaagaaaccgagctccacggctagtggagatgaacacgtccaagaatggtggtttggcttctctgctttaccttttccttttaacttttatttccatgctaggctgattctctacgggccgatagtggctttttaaaaacaattacgagccaattcggtgggtgttgctacagcattgctgcggctgtgcttcagctaagggagggcacaaaccactgttatcgactcgcagttgcagcctacacggttgtgataaagggcagccgaatagctcctatgtatagcatggttcttttctctaaaaacattctacaaaaccattgtttaaatcacttgttctatactaagttttggttttattcccacaaataaccaccaataatctatatcaatcatccatacaaaaacagagcataatgaccgcctggttaatgtggactgtggagtgtggacgcacgattgagctattctactctttaaacggtgttgaatattgatctggtccggtcttccagatgttctactccaggaaaagccaacacgccgtgaaagcatactagcagcagtagtacagtagtacaaatgcttcttgtttcaaacttcaaagtaaacagtagtagttgtaaagagagcgaaattgcttcaagctaaccgtattgtttacttcttgaccaggcccagatgtcaactagaggtggcaggcagtgacgcacaaactgcacaagtgctactccatcagtggcaacgttgaaaagtaaacaccgctgatgctccaaagctttcttccgttgaggaagtcaacttgagagggcacccttttgaccagtaaccacaccaccaactggaactggaaacatgctctaatgtgctagtgctacgtgccgtatttctatgttgagtcctgctatacgtatgacgtttcagttatacaactcatattcaactagataaatataattataaataattaaagaagaacatgtttatatgcactgcaaccatttacaaccattgatcaactttagttgtatgtaagttagacaggtcgtacgcataacaattttcttctatgttccatacgctttgagatcagtgcatggttcctcgaagacccgtctgggaagcgggacatttattttaaagcattactagaaaggcacatactacaagtatattatattcatataccccatgaaaacgtttttctaatatgttaaatacatattagcgacaaatcaatagcatcactaaaatttgaaagcgcatccgcatatgcgtaacatttacgaacactaggattcaaacacatggtggatggagttatgcatggcctccttttagaacgagctcgggagtcctaggataaattcacaatcttaccaatttttttgtttaaagttaaccgtgtgatataaaaatcgttggtattaaaatttaactcctgatagatgctataggacagaaatgtttccccttcatttgacatttttgatgcacccattcatttgacctttttgatgacataggacagaaaactacacccaagctaccttgaatacagatgtttggactttggaagggggcagataagcgactttctgtgggatacacatcaccatgccagcatgccccatgactaaatgctcataggccatgacagtagtttatgaaaacagataattttgatgctatgcgtgtattgataggcaaagctggaactggaagcagtcatgcttggcttttcgttcatgtatgggtacgtagcaatccatcagtccatggctccatgcctctagatgagccaaagggacacgactaacacgagtattagtgatgtttcagctcagttccccgaacctgtgggaagttaaatcattaatcatactagttcaatgaacattgtgcgttatttactcgtcaattctgatcgcaatcagcgaccaaacgcgctctcatcattgcgcagttggcatgttgcctatgtgccgaattcattgcatccatttttatttttgggtgtcattccttctgaacatgtcacgcacatgcgatgagccatgtctctgttatcttttgttccactgtccccttaggcccttatcaaatttagatgaacaagaagtagtacatagccatgacaaacagagatactgaactttgtggaagcacttacaagttacaaatcgctacatggctgacacttgtgagatttgttcaaattcatagtaccaggtaactatattttaatacggaagtagtacatagccatgacaaacagagatgctaaactttgtggaagcacttactttacaaatcggtatgtggttgacacttgtgagatttgtttaaattcgtagtattaggtaactatattttgagacggaagtagtaccatgcaagctaaatatagttgcattaatccgatcctgctatcacaaatggagtagagctaggaaaaatattatacaagagagtagacctatagtttgtaggaatacacatcagcaagtagcatcattttcccttatagttcaaaaagatcactcaagttcaccaaaaaggtgaaaagaaaacgatgatgaaattaagaattcatatcatcatccacgttgcattctccaaggtagaccttgatgcttcttggtgacccgcagttgccttctgcaataagagctctatcgtttgcagccatgtgttggattattttgtatatcatttcgatctaaggttgcatcaaggaaaggagttagtgcgtcaatccattgatgtttttaccagtgatacgagaaaagagcatggattacgggttacctcttcaggacagtggcagcgatctgcaatttgatccagtgtcaatggctcagcagggtccttgcagctggaagatagtaaactcgactataagcagaaagatctcctagtacaaaattaacacaacaaactggagactagaaatgttatcgtaaatcatatctttggttctcaccaatcttatagcatatccgcatctgtttctcatgaaaccatgtggagaggaattgaaacggttatatgttcatgacaaagagatgcctatatgtttcatgttttctttgtggagtactttgttcttatttaaattataaaaaaaaatattactgcaaaaaaaaggtcccacagtcacctcttccaactatttgagtcaactgatcagctattgtaatctatatacatatcattttttaaatggttgccgctaaccaaggtactcaaacatctccagaacatttttaacaggctattttattccaaaaggacgtgggtgtagttcaagaatttaggtcaacacatctatatgattttgtttcaagttctttggactatagccatacctagaaaaacaatgcgtggttattactgcaatgaaatcaaacagtagaagaaaagggaatgaatgcagttcaagaacattgatgttgcccccatgaagaaaaaaaaaaaagaagattgatgttccatacctggcttcgttaagaacaagtaggatccttttctgaagtgccaacacctctccagcagcctttttccctgcttcgacacctgtacaaagcataataatttgcatagatcatagcaacaaattttcttaacaattcttgagaaaatttaaaaaattacgagagagtcaaaccaggttgatgataggcattgatgttgattaaataagcataaagaccgacagcacgctcatagagtgcaacaagtgctccaacagctctagggtttacttcttggacagtgactgtaatagattcgcggtcatttgcataaagagctgaacgagttccctacaaaaattaactttgtttcatcatcagttttatgtaattggtatcatgtcaaatctcacttcatatttctatatcagatctggaaaattacatgtagcattccaaacaagtagtccccacatgtaacacttggttcaagctcccactcatgaccaggaggcctatcgcgcaaaacttcaataaaagtaacaaagaagttgtgcacaccttctctcagctgctgaatgtagctgaaatcagagataaatcattggtcatgcatttttctaatctatatataggaaagtaactgacacagaagatgagaagattgtaaagatgtaaacttacgcatgctggtctgtgcttcctttgttaccataaacagttagtccctgattaacctgcattacactatcatatgttaaaggcctgtttaggacatagtataactttttacagaaatctgtacattttccacatgaatagggaaaaggcccccctttgaataaagacctcgacatgactgataatataagctatgagaagaaaaaggaataatgcatacccgatttccatcaaggtcaaattcttttccaagagattccatgacaagttgttgcaagtatctactcaaaagaagcaggctatccttgtatggcaatacagccatatccaagaacagcaattagtatcgtaaagactaaggataagccaaaacacacaagcagtcacaatgcatacagatgcatggacatggaaggaaacttggaaggaacagcgaataagccataataactgatcaagttgaaaactactaaccttactgcctattccatccgatgcccaataccaacacaatgcaagcaaggctgctggattttccttaatctggacacgtaaaacatcataatcatatatatatttagttacaggagtggcattgactatttaacttgtattttatatgttcaaacaaatcatacttccagtattccctttaaaaaaaaaattcatacctcagtattcctagtttcctcatccatttgtgcagcaccaactagcatttccttgatgtcaatacccttgtaagttgtaataagtctcttatcagttgcaacattggaagtccatggaaatatttttctcctcaacagacaacagaacatgcaaatgtgaggcactgacctgtaatgctgctggcagtaaaccaacagctgacatttctgatgttctaccaccaacccagtcaaacatgggaaatctagctaaccacccctctattctggcagtgttatctaataaagaattctcttgagtaattgcaacaccctgcaaaatagctggtcctacattatatcaaatttaatcatggatcaaacacgtgcatccacgattagaagaaaataataaaattcacagggacctatgattcttattttgtttggtagaatcacaggaacctatgataatatacagtaagcaattatctgatcaatgtttggtcaccatccttgtaaaagaatgtcaggtcaccattggaaaaggtttctaattagcataatggatacataaaaaaataaattaaaatctggctatctatgttatggctcaagtactatgattgggagaagaacactaagacaacatttagtaaagcataatattacagtgatcaaatcatcaaaagaagggatattgcaggagactacttttttcgtttagaaacaaagtactacgtgacagacggtaaactgagaatgaaactttcacacccacagtctcgtacagagcaacatacagtatttgataccgaagagaaagaaagcatagaaggacaaaaaagaaccttaggtcacaacctgtttcgagaattctagtccagcatctcggaaggccttttgtacttctaatagaccatttcgtgtttcaggtgtgcctccactctagaagtacgaaaaaaataagatatatcagattagccatgaagtagaaaaaaaaacagataattagggtgtgcatgatgtacctttgatattacaatcacaagagttgatgcaagttctggtcctagctgtgcaatctgatggtcaattccagctggatcggtgttgtcgataaatcttatctgacacagccatcagaaagataaggtagatcacacttcacacacacagtactttgagctgcagaagacattttaacaatacattacattgcaaacgagctcactttacttatgggtaaataaagtccataagcaagtaagctactcagcctactctacagcttaaagtccctattgaaggatttgaatttcaacttggatcagacacaaatgatagattatttcaaggcaaaagtaatgttacacaaaacaaaagttcctagctcaaatgggcctttgtagtagatagatatgatggtgtagaaagcaaagactgttcatattttctttgtggtattcataaaactgaattctctattgaatttggaatctcttcgatgggccctgaatactcttggacctattacttcagcaaggaatggatcctagtaactatatagacaaagtaaatgagaagaaaatgtatggcagatggtacagtttacaggaataggaaataccatcagaggagggttatctggagcaagtgcctccgcaacaaattgtggccccaaagatgaaccaccaattcctatagaaagtatttgagtaaatcggccagcaggggaggatggaggtcttatctgcattaagtaaaccatcacaaaagtagcatgataagttgacacaggacataaaacgtacctacaaaagatgcaatgtgctaatgatacaatattgtattgttacgacaagtaatacaccactaagttgtttggatgctctgttatcccacatagaaccagaacttaacaccactaaggccctgctcttttcagccacttcactggattattgtcacggaaattgtttcttctactgcattgtttagttctcttgttgtaaggtaaattcatcaagtttatttattagaatacttaatttatatccataatcgtgtatataatccactacaataatccggccaataatctgcttgactacaatgctaacaggtcaaattattaaattaattaatattaaccccgagaagcagcctatccctatgacctattccatgccttatcacaattcacaatacacacaaatcgatcattgctatccgtaaaattgaaaacggactatccctcaagcgagtggaagctcaccttggcggagatgacgtcgctggcgaacgcgaggatgcgttcgagcgtggtctcgattttgtcgcggaggaaggagttgggggcgagggccgggttgcgcagccagtagtggccgaccatccggccctcgtcggggttggcgatggcgcccttctcgagctcccgcatcgccgcgaacgcccgccccatgggcgcctccatccgccgcaggaactcctcggtgaacccgatccggctcacgtcgacgaacagccccagctgcttgtgctggtacagccactccacgtagcggttccacagcctgatggggtccttgtccaccgcgccatgggcgaggacgtcggcgtggcccgactgcttggagctgagcgagcggggaggagaggatgacgacgacgagcaggagcgggagacgtcggtgatggagctgggacgggcgaggcggaagtgggaggagcgcgggaggtggtctcgccggaggcggaggccgcacgacgccccggaggaggagggcgccgccgccgccgcgccggagatggaagccatcgccggagttggagcgtgtggctttgggagttgggagttggaaggggactgggagtttacgacagaattgatgatgagattaaggtgataatttgatttttaatcctaatatttagtttggtagagaagatggacattgctagggagtttagttggagattaggtctttaataaaaacggatggctgagatttgcttagacaaaataaaataaaggaggcattcactcccaattatctgcccctaccttggtattaaaaaggtccttcatcaattcttcatctctatcccaccaaaattaacatgtcttctaaccaaacaaaacacttaatagtctcgtccctctgaactctcactctcactccctcctacaaactccctccgaccaaactggccggagaggtaagcctcgcgagatggaagctgctaatggggcccacttgtccgtgacggagcttacaggccgtccgtacggcccagaagcccagctcacgtgtccaagattgaagattccgagtgacggaatctttatgggcttttttacccttcgtgggactagctatccatcacacgacagatttttgggtgcaaatcacacagattttagattagttggattaggctcatttgatcacttgattagaagagtctatacatgtatcaacatatattaattatatatattgcatatattttatttgttagatctttatattgaaaaaaatatatcaccaacccatctactaaaagttaccgtgtaattacactatagttacattgtaactacactatagttattgtaactatagtgtagttacagtgtaactgtacacttacatgtcatatcaactaaacttacaaatataattttagttatataggattgtaattttatattttaaaggaaataacaagtatatatttacttatacaacatttttatcaaaattatagtgcacttacatgtcatatcaactgaatttacgaatgtaattttagttatatagatctgtaactttatattttatttcttcaatctcttcacctagccgcaacgacgtgcaatgtatgtactcatcaattatgtgccaagttagatgttgctggcctcatgcgtgcgtgggaaggaaacacatcatagccgctaattaaatcatgcacagactaatccacaaggatagtaaatccgagtgatttcgagccaaaaatttgtcgccagatttttagcaaaatcgttataggattcgtttctcatagtgccttttttttaaaataatggaataaatccgttttttttttgctaacaagagttacaatcacttattacacaaactcgttcaatagggatcacatatcatgtgacgtaggtaaaatcgaaggcttaaggctgagttcgtttaggagggttcccaaccattttccctcgttttccgcgcgcacgctttttaaactactaaacggtgtattttttttaaaaagtttctatacgaaagttgtttaaaaaaatcatattgatctatttttgaaaaaaaaagctaatacttaattaatcatgcgctaatggactgctctgttttccgtgcgggagggtaaggttcccaaccatgatccacgaacacagccttagggtttgaggatttattgtatcaatgttctgggctacgaggatcaaaatatatgcatatcccggtttgcagagttggactcaaccttaaaatcttaatattattggatgtagaggttggatttttaattttatttttttttaaaaaaatggaagatataaactcattatgtggagagattttgcttcatgcacccacttgtttggttcattgccctttctcaccatgccaaaaaaattggccatgctaatggactaacatgttcatttgctttctagaaaaaccagcatgttcaagatgctagctagagtgataaacaagaggctatacatataccaaaaattttgctgcatcccaaacaatcattttttaccaaaaatttgacgataccaattctttcgacaacccaaaacaatagttcttttgaataattaatgctagatcttaccattacaaagatctaaacacaggcccgttgtgtttagatgcaacatgtttcagacaatctcttctgattgtacatgcaactgtccttgtgactctctccaagtactgtactggttccatccagctctttagccgcgaggaagtttaggactagtagtagtgtagtacttataaaccgtgagctaagttaagctaatctcctactagtcctagatgtattgatccaatgtgtaacctgccggcctatcggatggtagtacggcacagtccctgaagcagtactctgacaaagaaaactgcacggttgctacgtacaccggtacacgcttaactgatgccggaagagtacaaggacagcttctcattctcattatgatcgtttgctgtagttttcttttctgacataactggtgaattggaagcaaaagattaattaggaaacacacaagacaaagtggagagtaagggtgagtttgagaggagggaaaaagagaagattgggaagatacgtaaaacgaggtgagctattagtatatgattaattgagtataaactattttaaacttcaaaaatagattaatatgattttttaaagcaactttcatatagaaaatttttacaaaaaacacaccgttagtagttcgggaagcgtgcgcacggaaaatgaaacaaactaactgacaaactcctcctgccgaacgctccctaagcttggctagttgcctgctggaaggcgctctagtgcatatggagatggattatattcgttctgctcaattaagtggggattaaggagccaaatccaatgatagccagatccgtctgcaccatttgcctgacaatactaatactgagttgtaaactttgagcttgctgggtttgaagtcaattcttaccataccaatatgagttttgggactaccaaatttaccgcgggtaaaaaattgatagaaaactaaacatgcatgagacactattgaaattgtcaagaatttgttagaacaaatattggcatcaatccaatcaagcccttttaactccaaactataaattagttgttttccatcagcgcttcccgaacagctaattaatacgttttcgttttgtgcagaaatttactatatatatacaagttttttaaaaaataaattcatttttcaaatatatagttgttaatatttaattaattagactacttctaagtgaccagtatgctacttctattcgatatataaggtttcaaacgggccctaatactacgatcaatcaaaggaggcccagggtggtgatagcctgatacggtcagcctctcatattcttagcatcattgggagattgattggtcctggccaagttggcaaccaacatgaatgaattaaattgatcctggacaaatgaatcaagaaacaacgcgactaacaaggcctgatcatccatatactccaacaatatcgttactgcaagtggccatgcaatgcaacaaatcagtttgctaataagctaggcgacatctcgatggatggatgagagcttgcatagggagtctcagcgcggagggcggcgacacgcaagctaagctagatatggcggatgttgtgggtgtgtgtgcgcgcgtatagagagagagagcagctctctataaaatatagtctttcggatattactatacaactataataatacaaagattgtgctataagaaacattttttaaaaaaaactactattatattataaaagtatttttttgattaatatctaaaaaataatttttatgcacccactttagatatttcagaaggtattgacctttaaagtgtatagaattcaactgaaatatgtcgaaacatgcacatgcaattatatttcccacaaaaatcacatattcaacaactgttttgaggtatgcaaagcacaattggtgttgaacccaatagtttaaattatagtgcccacgaatattctacaatgtaattgctcttttaattaaaaaaaatagtaaggctaggaatttacgtttctgttgacacaaaattcatcacacacacgaaggcatgggagatttgcatctgtgttgatctatgattaaagttggacatgtaaactaaagctgcgtttaaaataggatgggggagtactacgaaatggcagattcaatgttagattgattttttttttacgaagggagtataatcaagcgatctcgtcacgaaaataatgacttctttcccatctctcatttctatctcatcaatatgtacattaatttggagttatcattattttggagctgtaaatgcctaacaatgattccattaatttcgatgttgggccatgcaacaagcatactcttaacctcggttcgtgtgcattaatcagctagtagatcacgcacatcaattgtggagttaagggtcaaataagaaaaagtgacagtactgagggagtacacctacgtacgtagatggccgaacaatcgtcgctctctttgttttacgtgcttgtacttaccttctcttttgactcaccagttaaaactagatctaagatccctctaatgcaaatgtctagctagatctcacaggccttcctgagaatcgatgcactgtaacatgtgaccagttgccagttgggttatcttaattaaattcttaaattagactattgctgctgcagctctagctatatatactcctactatatatatatatatatatatgtatatatgtacatatatatgtatacatgtacatatatatatatgtacatatatgtacatatgtatatacatgtacatatatatatatatgtatatatctatatatgtgtgtatatatatatatatatatatatatatatatatatatatatatgtatatatatatgtgtatatatatatgtgtatatatatgtgtctatacatatatgtgtatatatatatgtgtatatatatacatatatatatatacatatatatatatatatatatacatatatatatatacatatatatatatatatatatacatatatatatatacatatatatatatatatatatgtataggacactcatatggggcaccatggtgcctgggcaccatggtatcaaatacacaaaatcactcaaattttttaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatatatatatgtgtatgtatgtatgtatgtatgtatgtatgtatgtatgtaaagagaggattaagcagagttataataatctctctaggtcaaaaagaagaagaccaattagcgttacatcagtcgtctatgattaatctagaggggagagatatatatagatatgggcaatgggacaagagccttaatgaccgggtcgaccggatcgcatatgcacacaaacagaaattacgtaccggaccaagctttaattgcgtgcattatgaatgagctgattgtgacacttcgtcgatcgcttgaacatgcacactgacacgatgcaatgctagggccctaaacccctaagacagcaggggtattattcgagcctaataaattcctttactcaaaccagtagtgctttatatgaaaatttctttgatttaccactcgcaaaagcttattgtacaaaataccgttaacgaaaatgtgtaacataggccatttcgtagaattcgttatggttttcctcctttctaccattatctctctattattacgtttataatactcaaaatatccgtaggcccgttattatttacccaatggccactctaccaaggatttggttgagatcaagggtgaaatataatgtgtatttagatgcgatagttgtcatccatattattttgaagtagatttgaagtgagtaatgtgggcggattgcttcggatatcgaagatggattagagtcgatgcaagcttagtttaaaaatggattaaaattattggaggttccacgtatatataatcagttattaataatgagtcaacaatgcaacaggcaacaatataataactatagagcatatgatttctgaacatgatttatactctcgaggacaataatcagtcagctatcaagagacgagagtcggagaggcatcgcttgctgctgtctaccatcgtgttgtaggccatcaccagccgtggtggaaatcacattatcatgaggctatatgctgagtcggagaggagattaggatggccggaaggggcgtctcttgccgctcgttacatccctgcattgcgttggtgagtggtggcggctacataggtgtgaggtgttacagtgtgagcttgcgatagaggagtctaggttatctgatgaattgatgcatgggccaacttatattctatggaacaaatggagtgattacatgggttaaaaacaaatggagtggttacatgggttaaaattttttggataatccaataaaaattccgtagcataattagtatccaccagatattaggaacaccatatctatatctgaatgcacgtattatatctactagatttctataaatacagtcataccatattctcatttcggatggatttgaagtagatctgatcttatctattttaacccttaggccctagtagtgtaccatgtaacgttgctagtgcatgtggttcttgatcaaagaagtcgtgtgtgggatacttttcattcaaaaagtacaaaaaaggtaaaaggggaagaaattttttcgtgtgatggcattcatcaaattcatttcgtagcggcatttagtagaacgaagcattttgtaatgacgaattgtacccttataaaggctactcagagtgagtatgacattttatcgattttacatcaaggtgtctaagtccgtcctcgtagggtctttcgtgtcctcctccctcacgggcgacacgggaggcggcaaccccgccgtcgcccgttccccccttcctcctccgcctcgccgtcgccggcaaagccgcgcggccacaaggacgatggcagcggggcttcgtttttctctcgtctcgccggtagtggggggccgtgcggatggcgaaagaccacccagatccgagccatcgcgatctggcggggaggcagccgacggcgaggcagcgtggtgaggcggcggcggttggcggtggtggcggcagggtctggaggtggtggcgatggagaaggagaagagatggggactgacgacggcgggaatggaaggcggtagcgaagatggtgacggcaggcaggatccagtcacgccggaggtggatcccccctcccccgaggacggatctggtgtggggcgagctcgcggcggtggcggcgctacggagcccgcagctggccgacaacagtagcggctgccggctgctgtggcaaccagatgcactcaagacggcgacagcggcgcggagctcgtggcgacggtggtggcagcggccggacaacggcgaggtggctggccattggcagcagcggctactgtggctgcggagggaggaggcacgatggtggtgaccgtgactacggtgggaggaggcatggcggtctcggacagctagctggaggcgtggcagacgaccgcacctagctagcacgacaatgattggaggaggagtcggaggccgacttgccgcagagaggcacaggcgatggcagtggaggctggcacggcgcgagaggcacgaccggcggtggtggaggccggcttggcgcgagaggcacggcgatagcgggaggccggactggcgcgagagacgcgtccgggggtggaggaggctgacgcggcgcgatgaggcccggccggcggtaaaggagacgaccacggtgcaaggagaagctaccggtgggtgtggcgcggtcttcgatgcacaaaggccgcccggtgggggcgccagtgcagtggtcccacatgtcggcagaggttgagcggtgatggagcatcgatgcgtcagccgtggactcgcaggtgatgagctgcgggtgaaaacccagcccggacttggccggaccgacaacgatggttcattccccctcctgagggcgttgtcgtgccgtcttatccctcaagggtggttgccaagcgaaagcccaatcttggctcttttgagtccctgccgaacggcggtgacggttttctgtcgcttatttcgttggagacgtcgtttaggcatcctcttgccgaaaccactcgaatgattggtgcgagcaagctctaggatagagttgggctttgtgttggttgtaaggactttttttgggcgatctcgtctgtgttcctttgttggcctagcggtggtcggtcacacttagcggcgaccggtccagtgctagccttctcccggacctgtgtgttggcaatgtcggtgtgtgggtggtggtatatttttttccttttttctagctacgaccttccaatattgtaatcttgtaattttttttctgctctgtaaatagaacttcgtaccatctcgtgcgagtcgttaaaaaaacattttatcgatttctcccaaactggtaaaattttctcataattactgcattctatttttcttaggacaattgcttatttgaccccgttttgagccctaactactaatttgaccctactttttaaagtttgcttatttgaccctccttttcaaaaagaagctcgcgtatgaccctgttctgttaagggcatctaacggtgttaactaaagcacaaaatgtctcttttgcccttactgatttgaccctattacgtgtgggacccacccgcagttccctcttctcctctcctctcctctcttctcttctcctctcctctcctctcttctcttctcttctcctctcctccacggggcggcgactgatgggccggtggcggcggcgctctgagggggctgagggagagggggcatgtaacatcccggcctagggcttaataggattaatagaatactcatatcaacaagttgcaacttcttttctggaagccaatctccaaagaactccagggttaagcgtgcttggcctggagcaatttgggatgggtgactgaccgggaaattcttcccagaagcgtgcttggcctggagcaatttgggatgggtgaccgatcgggaaattcttcccgggtgcacacgagtgaggacaaagtgtgcagaaaagacatgtgttggtctgtgagggcagtctatgacctatgaaaggtgttagatgtaagtgggcctggcctgggagaggcgggtcgttacagggcgagggtgtggcggcgctggctccggctctttgtcgtcgtcctcctcctcgtcagcagggcaccggcttcggctcttcatcgtcgacgagccgccgccaccactcctcgtcgtcgttgtcgtcaccagggctggtgccggctcgtcgtcgtcactggggccggtgcctgctcatcgtcgtcatcaccagggcggcgccgatctgagggggtggcggcgctgactcgccacaagtcgccgccgttgccgcaaggagagaaatgtggatagggttgggtggatgcatatggttttctaagggtattttgagtattatgaatattagttgtatttttttaattttaaatcaaaacttaatggactaatggaaacagggtcagacggaagctttgtttttgataaggatggtcaaataagcaaactctaaaaagtagggtcaaattgatagttaggattcaaaacggggtcaaataatagtcccattttttttataagtagagggcaaacgctcccattgcagttattttttactacgtgtatgttttaactctttaaccgcccgagacaaaattaagctacgtgatcacgaatctggagacaggagagagatctaccggacggactctgccctcgatcctctgctccctccgattccgatcgattgcagaggctcacaaatacacatatacatccaaaagagagagacacatactgtatagtactcgccctacatacgtacgcgcgcatttcgcactacgtacccggcacccacagccaatatgtatgtatactaattaacaaagcgtacgtacgtgcgtcagagatcacgtacgggacactgtgttgtacaagtgacaatctacgtatacgattacgtacgtacgtactagctagctaagctaactcgtgtgtagctagcaagctacgtggaccacgggatttattgacgttgtgcgttgcgtttgcgtatagcacgtggaccacggagacgtgtaccgtgcacatctacagtttcgtttttttttttgggctccgttaccgcgcgcgcccccggcaaaattagtgcacgtacaatgtacgggagctcggtttggtggaaaccgcacgaagtgtacatgtgaggtaagccacacgggcacacggaggagtttggttaggtgcagcgagatgatcatcttgtgctgaggccatcctgtgctgcgcgcctagggcgtaatggcgatatcaggcaccgtcaataattccatcgtgaatctggcggagccagagtttactcatcaagagtaggatgaaactactataatctaccctaatgccttttatcctttttttttaagttgtgcttcatttcatacaattatttttttccagatgtttcattacataagacgtgcatacatacatacaattaactaattaacacatcatcttcactaaattgttattaattaatttctttaccctcaagatctctaattatattatatgcatatattatatttactagtgtctagtgtgccaattctaccgtaagccttatgggaaaaatactacctataagacatcattgagaaattccccaatgtaatgttatgattttctaatcatttgattaattaaaatcaaatgcatcacacatcaccctcgctatctgtgttcatctgtctccaacacatcgtcccctaatcccggcccatcgattaggatttgagcgacgcactcgcatcgactttcctgctatcatcacatacacacctttctccctgcctcacgcgctgtcatccctttgtctctccgacttcacctctgatgttagcgagaagccgagaacaacactacagatcttctccctccacttcatttttctctctcccccatcatgtttctcattgtcggtgctcctgagctatcttcctccacttcttgtggtttctgccgttggatcggccatcaatatccgtcatctttaatacgtaccgtcttgactcccctactatctccaaccaaatctttcacctcccatcgccctccttcactctcacggctttagtggcgcccccaccgtctcatcatcctcctattgctcaccgtccactggtcttctagactcgctctaaacccaaccctcctttgaatcaatcctccgaccccaaaaacctaacccggtgagattatcgccacatcctcgttgtcggagcgagagaagaaagaggacggacacacgagtcttgagatcaatctaatggtttaaaactatgagaattgtttctcaaatgtctgtccaaactctaaaggtagttagcaaatttgcaaagaaaaaataaaacaaataatgtaagcactaccaggacagagtggggatcagattgcacgccgatacgagaggccagctgagccatatataccacgcactgataagatgcacgtacgcgggcacacctgcaggatacgatacgatctcgtgaccctccctccgatcctacgggccagagttttgcaccttatcctcgacagggcaatgattccgatctactatagctactctctcataaatcataatactactgcagttaataattaaacatacatgcatgctactgcacatatactgctatctctcttgcaaattttaatgtactacacgcaagtgaattaatgtaagctcctagttggtttttctactttcccttgtacgtacctgcaaattaaagcaattggggtcccaatggcaccttgagagaatagttacacaggccgtgcgttgtttaagccacggcgagagacagccggagttaagggttttgccgattcgtatcgacgtccttgtcaacaaaatctgtgcatgtctggtaccatcctttacgcccccgtccggccggccggcggcgattattgtcacaacaaaactgcactgttgttggagtactgttattttctcgtaccctacgcttattataatgaatctggatataccattatagtattagatagtatcccgtttacttctcgattagttttattctcggttggtttgttatggaacggagggagtacgcttagtggctcctttggatcatacgatctcagtcctaaaaatatactccattcgttttaaaataagtttatctttgtattctcttatttatctcaaaataagtgtatttttaagcagtttagagtttataaaagtaggagataaatgtattagaagtagataaatcagaggataagtgcattgggatttgataaagtgaaagttattccagtcattttacttttgtattagtatgtgttgagatgggtgaacaatatatttattttgggatgtaggaggtaaggaattttggttgcatagctaaatctcttatatttcgaaacgcaggtggtaggatttttaaaacatggggaaaaaatagaagtatgttgtcacatgctatacaatacttcgagattttagggtttgttctctttattgccactttgatacgtatcaaattttggtaagatagcaaactaaacaataccttatgaatgccatcctaccaaaatttggtagttccgaactttcgtcttataaaaacgctaccaaatttttgaaagacgtcaaactaaatatatccaacactaccaaagtttaacaacgtcaaaattatcaaaatttaaacattgtcaggtcgaaattggtaacaaaatgaacatgcccttcaaatcgaaaaacaatagatataaataatgtactctttggatggttcacattagttgaaacaatgggattttaaagaaaatcttatatgggagagagatagagagtttgtattggacttagcaaaataaaataatacaaagatttgatgtcgttattaaatttcttatagaatagggtagggaagcaacccatagaaatcttgtaacgctgtttttatttttttcaaagggtatcacagattttttttccaagtactttaatggtgcaaaaaattctatgaacttcattcaatctaaaggaaccatgcattactggctttactggatactgctgccatgttagaggaaggttaatagtatcggcgactgctggcggcaaccgagtgccacatccttcaatagagagctaatctataatgcatacaacaacatgcaacacttctttattttttttaatcgagctagtgtctactccaaaggaaccagccagattcatatgagaaaacataagtaaacgagcttccgcctgagcttccaaggataaaggtagatgaacagccatttgatccccatcaaagtctgcattgaaacctttacacactaatgggtgtaaacaaatagtacgcccctctactaaagtgggttggaaagcctgtatgcctaatctatgcagggtaggtgctctattcaacagtacaggatgtcccctcataacttcttgaagtatttcccatacaatgggttccttttcccaaattttccttttagcaatcctaacattagaagtagcacgtttcgtgattaaatcgcgaattacaaatagctgaaaaagctttattgctatctctagaggtaacccacattgatgtaatgaaagtgaaggacccacaacaatgacagaacgccccgagtaatcgacccgtttcccaagcagagtttcgcgaaacctcccctctttaccttcaattacatctgaaagtgatttgtatactttattgtgaccatccctcgttggttgcccgcgggacccactatcaagaagtgtatttcacgtccccattcattttttcattggttgtcgtgagagtaggtgggcctatggtaggtgaaatgcataggctcgcgcgaagagccagcgactaaatagtcgctcgtttttctctctccaagttttctttctcggccatgtataaaaaatcctatgtaagcatgctattaacccattgttgtacctgctcatgatactaatggtgcagtttaatctaggcatttttttagggaagataaactgcatatttttctgtgtgctctttcgggaaagccaatatatatctgagcactccctccgacggtggctgttaaattaaatcttgaaaaatccatcggtgaattcgaacttattttatctggaatagaaaatcacaatcagctactcactcagtctctctgttcaactccttcagagagggaggtagtagaacgttactgtcgtgatatgcgagagctgagctaggtagatagcgtttctagtacagtaataagcaagcaagcgatccgaaattctatgcaagtaaagcacaaaagaaccgccatgttgttagcttgaagctcttatctcccaaacaagtctcaacttgggtccaagccttgtacacgttgttgttttcttcttcttttttactttcaaccagtaatattgtaatcataatccgtattcagattgaatctaagtactgtacttaattaaccaagacgatccgtaatgcttctaggacggaaatgcatgcgtgatgtgatcgagtacatgtcctgctcctggccatgtttgtactaacactaatcacagtgtttgtatagtttttacactatatctgtactgggaaggaacaataatatcagacacatttgtgaatgattgtgttgtgttatatcatcaacaggccaattgcatttgttgcagtagattgtaattgtagttgagcaaaattaaatactaactagcagatcgagctcctctcacagtttcacaactgcacggggccaggcatttcatacatgtctatattttacacaagtctttaccaaaacaggaatactcctggattttgctgtacatgtctttaccaaaacagagtactctcctagattatattgtacaagtctttaccaaaacagagtactcctagattatattgtacaaaagtcttgtccttgttgcttgaagtacatgtacatttttttcagcataatttttatcctgatgtattgatcaaaattaggcttgaaattaaatttgtgatgtgattggtgacaccacatatactatagttacttgctatattttagaatagatgtagtagcataattttacaatcttgtagaattgtttgtgacttgtgaggtcctcataggaatatctaaaacctctcattttgcatttaagagcgtcaccaacagatatccaacactcctccctttgagaatctctaaagagaatttgagcattaacttcctaaataaaaaggtggctacttgaaaaacatagtttctcacccctcctacgtggttgtgcgcccttccttacacgatatcccgagcaaagactctgggagcgagagcgctcccacatatgtcgatagtaagaactcttggtgaattcaatttttgattaaattgcctctatagactataaatgcatgtcggattcaactttatatatatatatatatatatatatgacactcatatggggcaccatggtttcaaatgcacaaaatcacttaaatttttcaaaattttcaaattgtgagtatatacctagttataagaattcgattcatacctatacctatcaaccaaacaactcaaatttaactttatttcacaatccatgattacatacctaactaattatatgtatggatgctatatacctagaatcaaaatctaacaaaaacaagttcaaattcagttcaaatttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatatatatatatatatatatatatatatatatatatatatatatatatatacccaatttgaatgagtatgaaatttttttaaatgtttagatatgaacattaacttttttactaacaagtttgaactgagtttgaacttttctttgttagattttggttctaggtatataacatccaaacatataattcgttaggtatgtaataatgaattgtgaaataaagttgagtttgagttgttttgttgttaggtatttgtatgaatcaaattcatacctaggtatatactcacaatttgaaaatttttaaaaatttgagagaatttgtgtgttttataccttagagcccgagcaccatggagtcccatatatatatataatttctggaaattccataacttcagtagtactcccttcgtctcaaaatataagggattttagatgcatatgacactttctaatacaatgaatttaaacatagagccagtccaaattcatagtactaggaaatgtctcatacatttaaaatcttttatattttagtacggagggagtacttgtagtgtagacccaaacatggaaagccatcgttttcagtttgcatgcattgctactctgtttgatttcttggttacgctgaactatagtgtacagagtgtactcctgtcatttacttaccacacagtaatctcagcagcacgaatttcggatctgatctctactcgagttcgttagtactatgagtcttcagacagtacgtgttgtacacacaactagatacaaacagagagtagctgctcgtcagccaaaacgccctaattagcagagtacagtagtatctttttttttcttttcattttggcgctagagatgatcaaacaacgttctgtacagtacatgttcagcagtgaatgattttaggtggagttttgtgcttgtctttgatgtacatctacacttcaaatgactatttatgggtcattcgtgtggttaattggattgctagtagcgaatgcgtactgcatgtgtactgacaatagaatttgttacttgttagccccttttattggatcatcagctatcatgtacattttgccgattccgtttatctgtgtgtcataactaaccttggttgctctgtgatctagttcagctatatgtgctcgtaagataatcaccgggttatttaattggacaatcatcatcgctcaattagacaatatcacctgtttttttattataagacattttgtttcattaggataagattttagctatcattcgctttattaataattagttatgtgacatggaagcataattagtaagcatttttttaataagaatcttttctattaaaatagcgtaatagagaaattgtttgttaaagtattatcctcgtaaaataaaatatgtatatgaattccatttagaaaaacgtcaaggccttattaaaaagaacaccacacactaattatatacttgagctacatagtcatctcctatgttataaaatatacttaagctacatagccctctaacttactattgtctaactttgagggactgatatgtggacctacatgtcagtgacccacgttagagggcagtactttagatgagccctttcccaaccaaccatatacgatctcgaggtttctcatatactctctccgtcccaaaaagaaccaatttctcgctatgaatctggacaagatcatagccaggaattggttctttttgggacggagagagtacaatctaggtataaaatactccctctatcctaaaaaaacccaatcctacgtttgaatatgtatgtccaaattcaaacccaagattagtttttttttggagggggtatgtgtcaatcctgttataaaagcaccaacttattttgtctctcgttatttgcttgttagcttatcaattccaactcaaatttaattttattaagttgattttgagtcttttttttattgtagtctattttctagccttgccctttttctattgtaaccaccaaggtttaacggaaaaaaaattgtttttggttgcttttttttcgacttatttgtagttctaccatcatagccaaaggtaaatttagcaagggtttcgccaatttaccttttaattttttaaactgttgaacatataggggtgggcagaaaaagaccgaaccgaaaaattcaatcactaggccagtcaggtgttgaaagattgaattttattcggtcaattcggttagtactcgatcaacaacccaattaaaccgaattttgacccaattttagccttcagtatgctttgatttgatccatgatagtcaagagtctattttgtgtttatatttttttatctagaaattaagacttcgcttgattattttggaccttctaaaatttcggtcatgatttagacaaagaccgaatttcttggtgtccaagaccgatcgatctctaattttaaatgaccaaaatttctaaataacagatcgagactgaatttttcggtcggattaaacgcccaccctataaacatatcggacgaagcttcatgtaacgttacaaataccataaaaaatgactaaatttagcatgtagtactacctaggtataactcgctaaaagtattttataaccgtgtccaaaatcccaaacacggaagatgatcctctgatgttacccttcaacgtgactgatatgtgagctccaccactctcggacccacatgtcagccaccaaaccatttgaaagttacgtcacaggagcacatccacaccgaacgtgtttacacggccgagccttttgggcaacccttcgcgcgagagccgcaaggggcttgtcccgtgtcctcccagcctccaatctcagccgcccatccatccgatcggacggcctccactaccgtgaccgtgccctcttcctgcgcccccctccctccattcccgccccggctgtcccaatttcggcgtaccgtcgcgtcgcgtcgcgctttcccaaactgcccctctccctcctgtctccctccccagtacaaagcgcggcctcggcggcagcagcacagcgcgcagcgtctctctctctcgctctcgctatctatctctgtccttgtcactgtccgtccttgactcgctagcccaagaagaagaccaaccggagaggggaggggaggggaggcggagagatggctccgagctcgtcgtcctgccacgacgcggccgcgtcgatgctgctctgcgccgaggacaacagcagcatcctgtggctggaggatgaggagggggaggtgggggagaggaggagcggcggttgccggtcgatggtcggggacctcgccgccggcggcggcggcggcagcggcgggggtggagtggaggaggaggaggacatgttcccgcggcagtcggaggagtgcgtggcgagcttggtggagagggagcaggcgcacatgccgagggcggactacggcgagcggctccgcggcggcggcggcgacgtggatctccgcgtccgcagcgaggccatcggctggatttgggaggtgcattctttgatcgatctggcacaggatgcgccattgcctgaaagaaagaaaaaaaaaggaatgatttttgcgctgttttctttggtctttctgagtaaatgcaatagatctgccatgattagctccgttcatttaggggggaaaaacgtgtcttttttacttcgtttctggatggattcaaaaccattcctgcaacttgttttctcggccagttttcactaatctgcagctagcgttcgtccacgggcgtaaatgcaatgcatattatgcactgaagagttttttttttcactgtgtttcgagtaataaacattgtttgtcgtagtgcgataaatgtgacgatgacaaaagcaaattggggttaaattttgggaccatacatctcggacgaagctggcctttcatccgttcgcttactcacgagatgtcgatgtgcattgtctgattctagtttgtactactacaacgtttgcaatgatggggcggcattttttcggagccaaaaaaaaaaacttctgataaaagcatagaagataattgctgtggagttcttgtcctgaaaaatttgtttcttttaccatgtgatctctaacttattgtgttttttatctttctacaggtttacacttactacaacttcagctctgtcactgcctatctggctgtaaactacctggaccgtttcctgtctcagtacgagctgccggtaagaatcaaaaagattgtgtttgtaatcatctcaagatgtggccaatgctgtccatgttcatacaagtactagatgatgagctaagattcatgcttgcaaatacaggaaggcagggattggatgacacagttgctctcggttgcgtgcttgtctatcgccgccaagatggaggagaccgtcgtcccgcaatgtttggatcttcaggtcagcatcaaaccgtgacaagcatctcagatttcgcaatgcgttgcgtttttgtttgatattgttctaagcgttgttcttgttgttgatcagattggggaaccacggtttttgttcgaggtggagacgatccatagaatggagcttcttgttctcaccaacctcaattggaggatgcaagccgtgactccattctcctacatcgactacttcctacgaaagctcaacagcggcaatgccgcgccgagaagctggctcctgaggtcgtcggagctcatcttgcgcatagcagcaggtgtgccatgataggaagctgctgaacatggtttcattcagtgacatcctatagatcagaccataattcagcattctcagcatagtctgacgatgcatgttaaacttgtcaggaactggattcctagagtttagaccctcggagatcgctgcagcggtggctgccacagtggccggagaagccaccggcgtggtagaagaagacatcgcagaggctttcacccatgtagataaggtacagattgatgcaaaccctcacgtaaactcatcctcatagactcttactagctcgtttaattctgaataactcatgtgtactaccaatttggatccatcacattcataactgaattataataactcataatttgcaaccggtactttcgtagaacacagtaccggttcagaatgcgtgaaacgcatttatgggcgtgtgagctcggggagttaatgtgctgttcggcttttgccgctgtgtgtctgcaggggagggtgttgcaatgccaggaagcgattcaggatcatcactactccatggccaccattaacactgtgcaacctaaacctgcaagcaccaggagaggctcagcctcagcctcctcctcctctgtgcctgagagccctgttgcggtgctggatgctggctgcctcagctacaaaagtgatgatactgatgcagcaactattgcctcacatggaggaggaagaaggaagagttgctttgatagctccccggtcactagcaagaagaggaggaagcttagcaggtgactgaccagtcaaagtgccaaatgatagatcactctctctgtagtctgtacaccactcatctcgacaaaggcaaagtcaattggtttcgattgcaacgactgttagaaagaaagaacactggaagggggccaaaagggagggaattttgacatgacgagagagagctagctagcaagaagttgctgatgaataaagaggtgaggttgacaacacctaattgctaagcttttgcaagccagcaagccatggtgatgagaggtgcccccaaagaacaaagaaaagctttgtagcaacataaaagcttgatgagtttcaaaaaaaaaagaagaaaaaaaacataaaagctacatgagatgatcaagacaaaggatggtgaggggctttaggcaacaagtccaagaactaggcatgcactgacctggctgtgtagtattcttttgttcactagctctagttgcattagttgcagtattgttttcttttttccatttcatttgtaaggagaaaattagaggcggcagcactcctttttgtgatcagcaatgatgatcatccacatgaataaaataacatggtgtaaccagaaaagaaaattaacaagacccagaaaaagaggaaatgggtttctttcagtatattgctctgcctgcctatctctatattgtttgactgcttgtctgctttaagagcaggtataatagtaggctataagccagctgtaaatatattttaaggagataaataaggagagagaaggatagcgggctataaatttgtagccagctgtagcacgaactgtaagacgtagtatgtgtatgacaggcggggccaggtatcaatagtgtagtatgtaactattgtacgaatgaactattagattggctatagatgaattggagctagtagtaggctatactattaaactattaaacttgctctaagaccatgagcaccgcattccctaggaaataaaagaaggggaccttgtgacctgtcagcacgaaccttgggaagacaaacttaacaataccatgcggtttcagcgttgagcatctgtctctttgttcgaattagtaggtgcttctgttagtattttactccttaatttaagggctaaatgctcaatcatctaaaaagaacagttacatagggctgtcaagagtatgaatggtcccatgccgagttgggttggatacttggatcctatcataaagaggtccaatttgttacgtaaaaaagaatccatcgagggagatgaaaataggacaatttagaatttttcttcaaaattgaaaataatatttcagtaattttgttctctagtcatcgagggtgattggcggcggcgctcgaggacttgcggtaactagcgtgcctcaccgtggtgaatgatgacgacaaatgaggaatgtgattgagcaaggaaaactcctagccttgtttcactgtatgctacgaattcatagatttaccaacacccggtagtatagaaacacagttttaatccttttaactataatatagttaagtgagaggacacattaatctaaacctttatatcacttatactataagtatactagtatattgtagcgtaaaagttcttaaatattactccctccaacctaaagtatggctgtctctaacattacactgtcattaatcttttataatatattattaacaaatacaaaattaatatcatataaaaatacttccaaatgtgaatataatgatacaatatacataacaatagaaatacatttattggggttgtttggctgcactgtaaaaatgttgcattgcagtcagctgccgcttgacatgactgtggcgcagccaaacaacccacttgttactgacttgctagttaaagactacaagtgttgttttttcttaaaattactgaaaccttatgatatgggatagagggaatatgagaatggaatataactcaatttataaagaaaattctagcactagcactttataagaagcaattcattccccacaaaaatgagaaagagcccttagtttttatttttggctgcaaattgcagtgatgaactctcaccggattggaaatttcactgctcattcaaactagaagaccaaagactttttggctttgtgcccaacagtggaggctgaagatgtaaagttgtaaaccatttccattatctaaaattaaaattcaaacttggagacttaagaaaattggaatgatattgtaagctagtcactttaaatatatccttacacattctcttataatctactacatgtgaaattccttacattttaaaacggtacatttgcattctcacaaagtgtatataatgccagatcgatattcatacaagtgcattatcaccaatgagtgacatactggcatcaggtattagtatctcgggaaaaaaaatgattgtctataattcagttgttggcacttgaaattaggaaaagtttaccatatgaaagtttgtgctagtgagtagggactatctctatgtaatcatcatgccatttggcccatttctccggcagcatttcaagggaaaaatggatctcgtcaagctcttgggcagagatctagtacgttgtctacgcaaatcctatcatcagtagcagtgatgttatgatgtgtattagggcattggaccacagggtttaggcgtctacggagattatcctaagcgagagtctccatcatatctagtactactcaacgctgtcacatacacatttataatccttgtctcctttcatggccgttctatatgtgatcttgatctctgcacattacctaacattacgctcaagtataaatctacttatctacatatacccgtcagtgtacacaacgtctcttggcacgcagaaaggttaagaacaagaattccatttgattaaatttgcgtatgccacaccgttaaattatcacccgagatgtgagctcttcgatgttttaagtaaagtttattaaactcatcacgtttcgaggaatcgaccagtggcacagcaagaggcagcaggcgcgtacgtacaaagggaaagcctggaagtaactggtaagctcgcagtcgcagtggctgtcactcacagcgcgcggcaaaagctggaacggtacgtgcaaaagaccagctgatcaccgatcgctgagattattaacttttaacaggcgtgtgcacccgctaaagacgccgtcttttttactagtttttcgccgacggcgccgtgcagcgctgcatcaaaccaaccgtaactaatctcctctccctgaggagcatagttaaccatatcttggtatatcgctggggcgatgatgaacgtgtagcgacgcgggcggcagagatcgatggaatcgcgggtgtggaggcgaggcgaagcagctcatcgcgtgtgcgttccaggcacggtgctgactatctagctacggagttggtggagctcacgatgcgaggcggtcgactgcgtcgtcagactggtgtcgtgttacatacttacatgtttgggcaaaatgtgcacgcaggatggtgaatcttgtgagttgggacctgttggaggaagcttggggatttcttttatggttagcctgcttggattgcatttttgtgggatgcaacttgcgaagatacatgaccgatataacgtaattttagcataaaagacttttatcctctccagacaaagaaacccctccatttataatattatctttatctatatactacttaaaacattgatagtgtttttgtctaccataaatccaacaatcatgaccctttatccaatagatctaatggccagattcctacccctcgccttctgcctccacccctgcttcccgaatcgaactcggagttgatgagcaggactgatcggctccttcccctcgcctttcacctccgccctcgctttcgagtcggagtcagagttgatgagtaggatagatccaacagccatatccctactcctcagttgcccctcaaccttccgtctccacccccgcatctcgagtcggagtcggagttgatgagcaggaaggaagccatgttgaacatggagaaaaagaaaaaggaagagattgatcggttgatttcttaggctgaggtgatttggacgcaacgagcaggggtgcgacacatggccgaggtgcagcaacgtatggcggcaagagagcttttggtcggcgttggctgctttgtgaggaggcggtggaggggaggtccaacggcggtttcctatcttatcgatgttgtatctttacaatgataagctacctaatatgattgccattattgttaaaaaaaacatgagataacatgtagtttaatatgtttgccttcacccgttacaacagactggcattcttgctagtaacggtataaaaaaaagtaagtggtggacagtgaatctgtcgtacgtcccaattaacctcttagcttttggaaggtagaaaaataataggtgtggagccaaatggctcgtctataggttggaatgtagaaattaatatgtgagaaaaaagtaatggcgaaaacatattgagaacaatgttttatcattaaagttagtttaaggatgacttataattttttttcatatttacactaaaattttgaataaaacatataatgaaatgtaatgtccaaagttgtaataaaaaaggtgataaagaagagggcctcggtgttgaaataaattagttttgccggtttgacgtattttggaaataatttttataatgggacctagcaaaaacattttgtgtaaatcgatccttaataatggagtattgtgatcacagttagataccaattaatttaacgtcttgtaaattgatacgtacgatagtgcttgggcagatggcagatcagtagtgggacatggagaaaggggccattgagacgccgccaccgcaactaaagccaaggtcaggatagagtggtgggttgaatctgtagcgagagcaaacgcacaacgatacattaggagacagagggtgcataaatagatcagcggcaacatccgtcgaagacaaggaagaaggtaacattggggcaccgaaggcaagttcgatggcaatggacatggtagagaggaggtcaacaagggcggggtagtccagtgggctttctcaacatcaaaggtgacaccagcgaggcagatggatatatataacgtgttaggaagggaaatgggaggcaacggtacaatactagctagatcaagagggcgaaacaatatgtgttgggttgacgatatagaggagactaatatagtagtaagtccagacctagtttggacggttggattaaattttatcaaaaaaaatctcatgttacatttaatcgagttacatatcccggtgattttttgacagtctttaaatagattgcgtattgtgttgtccacgtgtaacaaatgcttcgaagagtaagttttctagcaaatcagttgtaaaaaatacccgttgaaattgttgtgtagggaattattaacatacgttaattaccccataattggctgcacaagtgggtaaagctaagctgcagcagagctcatcgagcgttctgctctgcaaactcggtccggccaatcaaaggaacttgcccgagccatcatgacggcctgcaaaaaaggaagatacaaaaacacagagaattttcgcacgggggccggctctcgagggcatcgagaattgcggggcgtccctgacgaggcgaacgccggttgaagcgatcggttcctttcgccgggacaccgccatggccaaggccaacaaacacacacggccagggtcgtgccgtgcaatgatcatcccgatcgatcgatcgatttctacggctttgcgagctcgttggcgagatgattttaccggtggaccagatctcctagcccagccaaaaagattgggcatggaggtagtaagctataccagctagtgccggaaagattcgagcaacgcgtgcacgcgcgcccgtggagacttccgcctctctctctctctctctctctcgtgcgtggagagaccgagacggggagagtatgtgtgtgtggctatcgtggtgtcagggtgcgtgccacattggatgctcggttttgttcaaggggaccaaccgaaatatactgcatggggatgcatcattgcaccactcaccacacacagcaaggtgcacatagtggtggtgcgcttattagagtacccgcaatggtaaagtgctatctataaaacatatacatctcagcaatagattagattaatagtaaaccacttcaatggtatgtctatatgggtatctatagctctctaattcattgccttgtttttctctatagactatctccaggttagtagatagctttgctctctctcttcatttaatctcttccaagtaggaaaatatgctgacatggatctcttgtagagagcctatagataaccattacgggtgcccttactcttgtagtagcagtagctacctatcctatatactccattcttggaggcttggagcagctagagcactagcgagacagaacggtgtgttttcgctggaaagaaagagagagcaaaagccgtgccaaagctaaccgttcgtttatagtactacgagtctgtgacaacgtgagccccaacattcacaacagaacaaaatcacacgctatcagctgatctctttcacagcaacacaacaacaaaaccctgttggatcttacgggtgacaaggtttttacaacaagcatttgtcaccatgcctctgcatggggcccagggacgtgcagggcagctagcctgtgttgtgtgtgtgtgttcgcctgagaccaaacatccccagcctgcaaggctggcgcacggctgcaattggattgctcgcgttgcagagcggcacagcttcgcgttcctctgccaagcgaagcgcgcgtgcgcgcgcgcggagtgtacgcagcgagacgaagtccccaaatcacaagtcggctctgggccaaacacgtcttgggccaaaaaacagacatgcttgcccatagatacgccgtacgcgttcacgagatccacctaggcttatatgggccttaagcccacaagcccacatcgacttgaagtccagaaaaaccatggccatccagaggacagtgaggcctagtgggagagaaggcagagagctacagtaaggactgacgcagcaacaatttgtggcaactagctcggcaaagcgaggagtgaggaccatacatatatacgtacatgacacagcaacatacccctgggacacacgtacatccgctcctttatactaccagcgtgcacatgtataccgacgactatagctagccaactgtggccaccatatctccgaatcaaactgaacagggcgcgagcatcgtcctcctacgtcggatagcagtgtagcgccactgtgctcacgtatgcacgctgcacaagctttgattttgctcgtggattcgtgcccggtagtactagaagacagttgttacagtagctatatagctacatcccgatcgataagctgttttacagcgtactgtacttgcgcacgatgctgtgtgcagtgcaaataatactgttcctgctgctgctgtactgcagataccctaatttggcatcggtcagccatccagccaggctcagggggctcaggctatcctgcacgcataaatccggcgacatggcatgagatctctaggagggcaggcatcacccatcacccgacatggcatcgctgcgacgcgctgcacagtgtcgcggcgccggggcgtgagccgtgagcggcgtcttcgacgacgacgagctagcgcgcggccggcgatcagcgtgcatgttaggcttagctaaaggccgtcctcgttttgtccctttcacgcgtagtactacgtacgtttacacaaccccctgcgacgatacgtccaagacggctttaaagcgcgagagagctagctaggtcctctagtaagcgtgaggcctgcgaaactctcgtcagtttttacggatagatagatcgatggatggatggatcatggatagctcgatcttttgctgagctgctgctccaacgtttgactacgagctcggccatgccgctgtctccatcaggtgtggtggacctacctgcaggtgatacacagcatctgatcccatgcatgtccaccaagtaaaggaggcgcctgctcgctgcatatgatcaccggcttgccatgcactgttacccgtctctgtctgagagagagagagagagagagagtaggaggaaaaggttgtgcaatggggatcatatctttagcaacaaccggtccacagtacaagtgcgtgcatgcagacagccgaggcatttggaaccttactgccgctgcggtcagcgagacagcgagcgagctgcatgcccatggatgatggatcaagttgatgtcgtggtggtgtctctttagctagggctttagcttggctagctagctagctactactacaccttttgggggtcgactcttcttcctcctacactttgctcgctttccatcaagtcgtcgaaccggaccgaacatgtgcaacccctactcccatgtcgactactgctctcttccgtttcaaaatatagtaatcttagtatgtgattacacatgtgctaattctacaaacttgatcaatttcatagtaacgaaaactatgttttatttcatactatatatgttgctgtatttttttttttaaaggatggaaggaatacatgctttgcggtgttgcggtaggcgatcgatcggcgctgctgctgcggctttgctggctccggagtccggacggaccgccggttcggcccagaaaccacaagttgggtccatgctcttttgccgctggtgaaagggctggctctgcattttgtcgcatcctagtgaagtaaaggctctccctcgatcgcctctcccgagaactacgacaacaaggctgtgcttatcctgctctccagctttgtatgtgtagttgtgtactatagcaatgaagggaaaaaaaaactgcacctcattactgtgttctgctgttaacccaaagtacaggaatggaaatttggattatcgttccagattaattgggcaacttggttttgagcaccattgcaagtttgcaaccagcaatcagtgcaacaatctctagtgatcacgggagccttagcagcttcagatagtaatctccctaaaaaaaaaatccaaattctaaccaaaattttatgggtttgttcattttgaaccttttctaaccaaaatttgataagataacaatctaaacaaaatattaccaatccaactctaccaaaatttgataattccaaaactttctactctcaaaacttctaccaagagttgaaaaggcttccaaccaaaccttaccttatcatactaaaatttgacaatgataacatttggcattaccaatagttgataaggtctctttttttttggcaaagaagcgaattatccccaagacacgcagctacaatatcaagaagataaattagtagcaaaaaatgggatgactctatagctagatatgcatatgggaatatgtgcccgaaaatgaccgtggggcaataactgggaatgaccgtatcttaacgcctcctcacactctttaaagccagcgaatctcgtctcggtcaggtacggtaccaattgaacaagttgatgatcgcttgcttccactgaatgtacagtactaagttgcagcattgaggatcacatgtattgcagcattgaggatcacatgatgtatacggcatctgtacgccgtgttgatgaatgggctcatggttaaatggcctcgacggacgtgaccggaccggccggccggatgcccggaagcattcagcgtcaacatgccgacgttagccttacagggttacagcacacgacggtgcaaggacatgcctggcaatctagcatttcacattttcactagagtgttggcacggtcacctagcttgcgacctgcttgccagtacatgagtaattgctaactacaccgagtacaagattactactgctccagctcgtgatcattcctggtacaattcgaaaaattcccccaaagggtcacagctgtattacatttgaaaattttgtcaagggttaagtccaactttaactcatggaatttgcccaaagtccatttctatctcacccaaaaccaaactacaaaaccgtttgtttttcacccacaaacccaaaaaagtcaggtaaatggtttttcactaatatgaacatacgaatgcttgcgtaataaaagtacgaactagctagaaaaacaacttacatttaaaacaaaacaaataaaaagtactagtaagttccaggatgtacttcggtttgcaacattagtcatcttttgaagagttcataatgaaaataatcaggttgtagttaagataaaagatgaacttcgaataaacttcaaggtccataaatggattctacccattttgtaagtggatgcatcatcattttagaaaatatcatgaaatgaacaaaatgaagattgttgtacaaccaggaagtttttctccggtccctcaatattttcaagaatcaaggaaaaaacatattgaccttttgtttttccttcaattgaactggagtacaaaacaaaatgggagcggaaaatatgcccctctcctaattaacgaacaccaaaaatctgtccgacttctagaccacatacataattgcatgtgtaattcctgcatgtataatatttttcccatcctgattagtgctacgagctatatatacatcttgattcctccccaaaggccataaagaactcagaacgtatatatgttcacgagactcaaatatttagatcattcgggagattaacacccaccgccaacgcacataatcccccaagcaatataccctccaactcaaaaagaattatccatgtgcatagccaaaaaccaaagtttcttttttagacgaaggtagtgcataatagggaaactatcatgaactctcgaggggatgccccctcaaatagttatgaaaaaaaattaagatgtattagcatgtgatatatcactccataaacatacaacttagattttaactttatatttcgcaacaaaaaaacaaattaaactacagctagttaacgtatattgacagtcaaatttgtttttttcgttgcgacatgtaaaaaataaattttaagttgcatgtttgcaaagtgatatatatatatatatatatatatatatatatatatatatatatatatatatatatatatatatatatatatatatatatatatcacatgttaatatatttctcaattttttcaaaatttttcataataatttaagtaacatgcaagcaacgaaaagacatcccctcgagagtttaaaatcaactcctgtgcacgtaacaatccaatgggacagaacaatgccaactgggcatgtcctgctccgccgatatcctcttgaccctaatctgttcaaatttccctaccatgaaactgaaatatagcctaaatttttagtacaggtcaactgtagacacaacttccctttcgccatatagctaaggattacatatgcatgcacacagttcaggcgtcgaacccagtggcgcaaccagtggacatgtgagagcggccgcgctcagacagcaaacttccaactccaaccgccatccgaaacccaaccagatttcttcccaattaaatccccctccctcctctactcgatcgctctacacgaccgatcgatcgatcgatcgagagcctgacccacgcgtcgtaccggaccaggatgttggattccattaatgccagcagctatagcccaagtagcttagctagccatacaccgccgtcggccagcttggcgagaccgcgacgttcgcgcgccgcgcggcaccggccgggagggggggggggggggcgagcgcgacggggacccgcggccgcgcgcggcacggcgccgtggtccacgtacgccgatctacctagctcgtgcagtgcggactacgcatgcagcgcccactaccaccttgccgcgcaacaccagcatttctctctcgcctcgtctcgtctcgtctcggctcggggtcggggtcggggtcggggtgtgcagtagaaaacaaaactttgcaccattcagattctgctagcgcacgcctcgccaccaccaggccgcgcgcgcgcggccgtgtctacagtctcgaagtggccatcaaggatggcttcaataatggcgggggcgggcaaaagtacaacacgggggggggggggggggg

SEQ ID NO: 69564 - DNA, 11402 bp, Oryza sativa
  unsure (1)..(11402): unsure at all n locations
ggggggagaggagagcgcgacggggaaaaggggaggctcttcgcttttctctcccccccttctgcgctgcgctgccactgcacgcagtgcaccagcctagctagctcaaggccgcagcagctaatcctatccacgctctcgatcacgcgccacgccagcctttcgcacggcgcgcgccgccgctgtcgacgacgacggcgaaggcaatgcgcgcgggccggtgaaaagcaagaaagtggccggacggacggccaaaagagagatcaccggagttgttttttttttctccctctccccgtctttctctcccccggcctttccttcaaaagataaaggagaggcagcttgcaaggctggctcccggcccccggccccggcacggccgtctccttcctttccggccgtggagcctaccattttaccttgcgagccgcgccattggcggatgccatgatgctctcaattcctatccctctcgccaagcataccgcatggtgatcatggccaggacataaatgtgcatgctagcctgcgagctagtagacgggaggagctcgtcgtgatcatcaatggcgtatcacgaattcgatcgcaatgaatgcaacggcctcgtttaataaaagcagaaaggtggatcgatgttgccacgaagtaaatggcatgagcagaaatgcacattgctgcaagcaagcaaagagagtagcaagacaacaagcagtagtgtagagtaaaagagaggacgaggcttcattgaattcacataggctaaattctaaaaagtccccggccattgctatagcttctgcaagctctgcgtcctaacacatgggcagcaatgcggcatcactgctcgcgagatgtggaagacgagtaaatgcagcggatacagtgagatcgagaactcggaagaaaaatgcagcgaacatggtagctagagaaattggaatttcagagtagacaggtgaagcggacggatcatggacaagttggtgcccaggtctggaaattggaagcgagggagatcgatgtgaatgcaacagtgttgcagctcatatagttgcagccgacctttctgaatctttatctgccctagttgttagctagacgaactacaagtgctactgatgatgaagtgccaagcacaagaaatataggggaaaagaaatgatgaaacaaacaaaccgtgcagcaacccaaatccccaggaaggaaatttcaattgcaacacaaaagtactacattcccaagatctaaatcgatcggcaaatcgccatccatgtcctcttccttcccaacaccaaacgtcgtcgtcatcatctactaggaaacaacaacgacggcaaccacaagcccaaagaacccaaccacaatggaataaaataacgaaaaagaaacaaggaaggatgcaaaagcagcagcagcagcaaccaccacctcccctaaaaccaacaagaacagcttgctcgctacgaacctagctaagcttctactcaggtgaggtaaaagaaggcaaagaaaaaggctaattagccgcgggtaaggaggtagtagaagtagatggagatggtgatgcatgcagttgcagttgcagtgcaggtacctagcaccgggaggagatgagctgagctgagcttgcttggcttagcttagctatggcgccttcttgcccagggtgtgcttgttgttgtgcatccaaaccttgaggacatggcgcttgacgcagacctcctcgcagaactgctgcacggcggcctcgtcgtgcttctggatgcgccacccgagccgctccgcgaaggcgagcatcttgtccttctgctcctgcgtgaactttgtgcggaaccgcttcttgccggagccggagccggaggggccggcggagccgagggacatgccgaccatggggccaatcaccatggggccgaccatcccggacatgtcgtcgccctcgtcgcgtcccgagtgggaggtggacggcagcgcgaggggccgctgcgggtagccgcccgctgcggcggcggccgcggccgccgccgcggccgccatctggtgctgctggtggtggaggtaccctgccggggtgcggtagtagggggagaactggtggtgcggcgaggcgccgtaggccgagatggcggcggggacacggcggaaggctcggccggcccgacgcccgtgggggactccgactccttgcggtggaagttacggtggcagccgcaggcggcgcagcggagcgcgtcgatggagccctcctcgccggaagccatgaactcgccgcagccgtccacggcgtgcccgccgatgccgacggcgtggttcttgaggcactcccgatacctcgcccctcctcctccaccaccaccaccaccaccaccgccgccgccgactccacctcccggcttgggcaccccgccaccgccacctccaagcccgggctgcatcggcgcgtcgtagcccgagctcagaggcatcggaggcatctcctcgtcgccgtcaccctcgtcatggtcgtcgaaatccatggccgccgaccgaccgaccggccggccaccccctttcttttccctcccttttggatttctcgggtgtgttcttggcgagcttaagaaaagcttagggagtaatagaggaaggagacgaggctatgagcaagtataggggagtgtgaaactgtggacacacacctgctaattttgacgcgccgctgcaagcagcagctgctgctgttgctgctgtacccttcagctagtaggagtagctagctagatgatgcaataaactctctctcactcactagtgagagtgttactagtagtacttgtctggggcgcacctgtcgcgccggggcaatgacggggcggtgtgtgagtgaagtgtatctctgttgtctcgcgatgtacagtagtatgtagtaagtacacgtctccgctcggcggcatccgtgtgatgttgtatgctactggaagtgggtttggctccaactcgttttaaaaatgggggtttagggctgtactaggagtgtttttcggttgattgtgacaggtgcttcgtgtttgaaactcgttatccccatcataacaaagtagattttgtgttggactaacgcatgatttggagtttgaaggtacggtagtagtaccgtgtttttagccccatgttggaaacgggcgtgatgtgtcctactgggatttttcgtaagagttcaatagtagtagtaacaattaataaccagtccattgtttcacaagatttccggatttcagacttcagagaagtcctccaattttgtttgcttctgcaatctttatatggctttctaaggagcaaccacacgctccgtccatcccaaaatatagtaatttgggagtggatagttcaatgaatctagacaagaggttgtgcagatttattggactaggatatgtcacatccagtcctaggttgttatattttgggacggaggtagtacgtattttgctagtacgttgtaatgacttatatacaactagtatggtggtccgcacaaattgcgcggctaacatcattatattttctcttatataacagcatatgtgttttctcattatattattcaaatatattaaaatgacaacataattttaaattttgcaataactttacaaaactactaatgtgtaatattcatatatattttatatacgtgttagttattaattatttttaatatcaaattttagttatttgtaaattatatatattcctatatggactctagactcgtcttttcatatttctttttttaatttcgaattttctgtaaattgtatttctatatacactctatgttcttcttccaatattatttatttttatttctgaatttttattatttctaattgtatttctatgtggactctaaactcatttttcaatattctttaatttttaatttcgaatttctgttacttctaaattgtattcctatatttgtattcctatattaaccttaaactcttcttcccatgtttttcttaattttgaatttttttattgtaaattgtatttttatacggactctaaactctacttttaattttattatatttattctaaattttagttagttttaaattcctatatggactctatactctatttctaatattccttattttttaattccgaatttctatttttttcttaattgtatttctatatggattctatactctacttctaatattctttatttttaattctgaatttctattattttctaattgtatttctatatggactctatactctacttctaatattccttatttttaattccaaatttaagttatttactaattatatttctatatagactctatactctacttctaatattccttatttttaattccgaatttaagttatttcctaattgtatttctatatggactctatactctacttctaatattcgttattttaatcctgaatttcagttatttcttaattgtatttctatatggactctagtctcctcttctaatattccttattttttaattccgaatttcagttatttcctaattgtatttctatatggactctagtctcctcgatcttctaatattccttattttttaattctgaatttcagctatttctaaattgtatttctatatggactctagtctcctcttctaatattccttatttttttaattccgaatttcagctatttctaaattgtatttttatatggactctgtcttctctttttctccgattaatgtgagaatttctaggccatgagagcgaacgtggaggcttatttttctattcctttaataatataatggatggatggatctttaagaagatatcaatatgtaccaagtacgagtagataatccttatatccatcgatggagcaaaggaaaaggaaaaaaattctaaagatgaatttgacaattttagttagaaattatatattttcaaaatttctagacagtatctcaaggttttacatggagatttttatgagaatgtcactcatttgaatatgtacgaggctaaaagatacagacccaattcaaatcaagttcgagtccacctcgtcatccatgagcagccgcaacaaaatcgccgcctggacctcattcggactcccttttttatgttctagatatgtacagaaagctaacgagaccacctttccaatggatttggtatcacgtcaaacatacttctaagtcaacggaaactatcgaaacaagagagcgtccaaaaactgtcgggatgttgtatcattgtctttaaacctattgagccgtgtatcatgttagagtccactagggatgtgtttaggggtcttaggtcggccctagaaccaatttaatcagtaaccatcatcgaattagagttgtgttttacttagattattctgtcactacagttttgttgctagtttggtttgtggaacccagagatatcttatcaacacagtatatttagattgaatcttccactcccttactagtgttagcgattcgtttgcaggagacgactttttcgatgaggccaacagaggggcagtgtagtgattgcgaggagttcggtcattctagtaatcagagcctctggatcatcaactttgagtctccatgatcaacctatctagtatctaatggaagattgggaccctagtcctcatcagtttttagccaaccctaaggctcaagcattgtctcaagcctggctctgcccctgattatatccaaacattttgttataaaaacaggtatgatcggcacccatggtttgaatctccaacaccattaatatgtgcattgatcatggctgcttttgaggtaaaccaccatgccaatttattgttgttggattctggatcatttggaactagtattttttagggcaatacgaaaataccatacctgcatatagcttttgataagggaaaaagttttgtcgcatatatattattagaggaggcctacaacaaagataaatgtatgtataggacaggcaaaaaccatgcctacaaaaggaggtaactaagtgagctctcccaaacagaggttttcggagtttgtacgcctccgctttatcgaagtcactggctctttttctttgatctttgctattatggtaggtagggatgctaccacgttgcagaaggctcacacattgcacttgcatcagacttcccataccacatgtagtaactccttgatgaagctctctctcatagcctgatcttctggtgaggggataactctcacttcaatcaaatgcgacgtagctatcaaccagagcaagttcaggatgtcatgcaatcgctacaccataaaacgatgtcgtaccaattgtgacacgcagttgatgatccctgcaatgcaaaggagagaacactgcaagaacatgataaatgcaattagatattgcgaataggtaattaagcacaaagaaatagctgcgattgaagtggtagatccaatcgacccggcaaatcaacacaccaattatttggagctttgagtctatagtcgttgactaatcaagtgaggactagagacaagacgaatgtcacctggcaaaattcaactaaataaaatccaattgttctagagggtgtatatagacatttataaaggaaaataaagctaggattaagtgctagttcatggaggtggagagaagcacttctaaaatgggcctaacctattgcaaggcccaaggcccaagttcggtttcaacaacaccactttattgttttgatgattcccattgacttcaaatgaatttggatatgaaaccatatgcgtttgacaggtgacaagataagttttccaacaagtctaagattatctaaatcggagttaacatgaatgtgctaggttcgtttaaagttagtgttgtctctggaggccgaactggacttggacttggaattgtcattggaacgtgtgaagttatgtgcgtatcctatgaagtgatgttctcgagagtttaaaacactttcccatcaagtatcattttaaatatatgaagacatatatatagttgccaattgtttcgacactagcaatcataataagaacataattattgtttaggttaaactaaatactttttttaacagccaacactagacggtgcaatgattcattaagtagaacagaaaaaattacaaagctagcaccctagaaggtagtagctaggaaaggaaagaaaaacaccaccaccacgcaccacgcaccgaaaacacatacacagaactcagcagaaagctagcaccgaacctgttgcacctatgccaacagagaagctacaaccgggccacccaaagctaaatcctaacagcgagcaccgtactcagctctatccatgcccttagggttcaaggagagaggatgagagagaagatggaaccgctctcctctacagggcccgtcaacatggccaacttgcattgactagggcgcctccgaaagaggacatcaatcaagaaagagcacgcacaacctgtcggagagaggttttggtagtgtctcctgggagaaaaggcgacgatgaacacccatatcgttgttcttcgaggcctcgaggagaatcaagacaaggttttcaccaggctgcctacctgagagagaggggcggctcgacaacgctcctaagagggaaaatgacatcgttgcttgcccggcaaggccaagctaggatttacacctgctgcctgcccctttaatgctccaatgctgcatcatcgaccatcctctatcggcatgtggtcaccgatgtacctgcacaaccccacaagtcagcctccccggcccccctgtcgtcggtgatgtcagcctcccgctccatcgagcgggccggcctccttgccatcgcccgaactaaccctcctggtgccacacacgccgcgccagcctccctgcgccgccaaagaaaactctagcctcccacatcaaagatacctgcaccgaggaggtgagttggatctggctctagatccggcggcgcccaatgcggatcctttggtgcccatcgtggccacggcctccgacctgtcgtctcgtgcttcacgctcggtctatatccctccgcttgtcgcctccgcctctgtttggttctggatctggtggcgcctggcgtggattcggcaacgctcaccgcagccatgacctccccaccaccaccgtctttggtctaccccaccacttgtcgtctcctccgcccccgcctccacctccgcctatcaccgccgtccatgcgtaggatccgtctggcgccgcctccgtctgcgcgccaaccccgacaccggcaccactccgatcgtcccccaccttcggatccgaccgcgttgtatctagggtggtcgccatctcgagccccgccgctgctatcctagcaagccgccggcaaagccggtgactctcttaggaggcggcaaggcagaggaggaggggaaggcgggtggcagcggcggctagcgtttctgccgcccgagtcgcccgagccggaggtgacacatgtatcacttatgttttatgacatccctttatttatcttaaaatacttcatatggagtcatttgttaaaataggagtttattaaggttctaaagaatactccatttgaatcccttatgcttacactaaatgattttttaggggcacaaaaattaatttacaaaagtttggatttctcatcaactgggcaacagcaccatccaacaaaatgcgaagctagagaagcaatgcgttgtcattcaactgctaatgcattgcagtattgcaccatcaatggccgcggttgaacatcgacccaggacggctgatgtgctgtgttttgggccgggattacaatcttcttttgtacaccctgaggttaactacatatacttagattccgtgaacatttgagtgtttttaattatgtacttgtaaactcactcgatcaccttctgtttttcttgctcaaacaccgtgccgtcctatatatatctgcctggcataaacgggacagcctcgtagctaattaagaattgccatccaaacatccaaaaccctcgatcaatctcgtaactaatccagctagccaacgtatactcgtacgagagagatactgtaaatctgaataatgatcctaactatacagatcttaattgttgttcagatcgataagcggtacaattacgtactctacttagagcaagtttaatagtatagccaactactagctccaattcatctatagtcaatctaatagctcattcatacaatagttacatactacactattaatacttggttccacctgtcatacacacactgcgtctcgtagtccgtgctacagctggctacaaatatttagcccgctgccattctctctcctcatttatcttcttaaaatatgtttacagctggcttatagcctgctattgtacgtgctcttaggtacacgtacatcaccgtttgctacgtacttacaaaaggaatctaggctgaacactttaattatcagtacatattttgatgatctgagatcgatcagagctgtacgtgttatggcgaattggcgatcactgttcatttgtaatggcctcacatgaaaatggcaaggtcacccggtacagtttgactaactagacgaggtacatacatacaggatgcatggcagtatagtaccgtatagtactacgtacgaattgaaagtctggtacatatatattgcgtacttcacgtaccgaagctgcaaatcttaattgagtgaagtgtgtacagtagggatcggatcgaccactagctagctagcagctcccacacgtactagctagtacgttttctttttattcgcatgatgaattaaaccgtgttaaaaatgtgatgtcgtagtaataacggatcgccaaattcttatatgtgtgaattgttttagccttttaggaatagattgatgagcacccaacctagacaaaacgtcgccggccggtcaaacagtttcatttggctgtcaggcaaactcggagttatatgttactcactttatcctaaaataattttatttttcacctaccttacatatatcaatacgtacaaaagcaaaatgactataataccatcactttatcaaattccaatgtaattatttctcattttatctactcttagtgcaattattttctactttcataaacttcgtcatgcgaaacaaaagatctattcactccatttcatattattataatttactttgactttttgctaaatcaaacttctataagtttgatcaagttcataaaaatgtaacaactcttataacaccaaattagtttcattaaatctaatattgaacatattttaatattatgttcgtttggtgttaaaactattgctatgtttttctataaatttgatcaaatataaaaatattaactaaaaaaagtcataagtctaataatataaattaaacgggggaatagtcattactacaacatttgagaaaaaaaaaagacgagaactagtgtccgatggaactatattaattagaaacacacgtataaataatctaggtaattagactgcaacatccataataatttgaaaagatgaaacattgttaaatccaaaataaaacaaacattaaattgccaacatctgtaagatgaaaataattaataaaatcacaaattaaagatgtcagacatattaaacgttgcattcccatccctgaaacttcatattccaactgctggaacatcaaataaattgtaaaagcattctaaatatgtccctttctcttgacgcctcataaatcggaatgtggaggacatcccattagttggctgcaacgtctcgttggctctagtgtagttgttatcggcttcgtccttcttgtacgtcatctccacttatggacatgagaaagcaatcctgatgatcagcttgcctatccgaatgtgtcgttttgcctttgaggttgaattgtcccaaaattgctaccaccgcaaaggtcaccacctccacgatgcttcacatgggcaacccctcacttatcctcatgcgcaccttcccatgaccgatcgatatccccaaatttgacgtctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69565 - DNA, 1374 bp, Oryza sativa
  unsure (1)..(1374): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgccgggggttgctcgacggcggctgattgcggcggcggcaaccggcggcgggagaaggggaaaacagcgacgaggtcatggggggctaattcctggcggcgagagcatctatgcggctacgggaatccgatgctagcgtcggattgggcggagctacgccgtgcgaggccggcgacgagcgggtgctacggagcacgggcggcgacggcggcgagcacacggcgagcgacggcaacggtcggggcggcaccggctaactacggggaggctactcgagctactaccgaaagctaagggggggagatggagcgaggaggaagaacggagggaggcactaccgtgcgggacggggcgcagtgacgagaggccgacggcgcgggagtaatctctccggcctcgggccggggaagaggaaggagagggcgcgcccggagtccccttccgcgtcctcgaacgcaccggctctccgacacgcgcaacgacgaacggcgacggcgaacagagctcgggggcggcggcaatggcgcggaggcgatgggaggagaagagagggagggcgcccggggcttttaagggcggcaacgtcggtttgggaaccgactttgggcggtcaaggcgcgagctggcgctcggcgctcgcgtccaaatcggcggcagggcggagggaggaggatgacgccggcggtgacggaaaaaggggaaaagagggagagaaaagggggcttgcctccttgccgcttttggaaaaggaggaggggagcgggggcgtcgcggcagagggaggagggaggctctgcctccgtcccttggaggctagcgcgggagtggcggggccgaagcggtgacgacggcgatgacggcggggcggtgtggagcggagcggcgacacgggcgacaggcgcgggcaggcgcggcagagggtgacggcggcggcgaccaggcagtcggccaccacggcacgcgcacgcgggttgcaacgggaggcgcggcggtttgagtggcgcggctcgggcacgcgcgctggctgcggggccgagcggctgcgcgcctgcaggcgcggcagggcaacggggccgggcggcgcaaacggcgcaggcgcgacacgggcgacgaccacgcgggcgcgcgcgcgaacaacgacgcgcggggccgattccgcgggcggggagctcgccagggatggaggcggggagaaggagatcgaggggaagg

SEQ ID NO: 69566 - DNA, 7521 bp, Oryza sativa
ggcggccgaactcccaactagtggatccccacaaatttcgcaattagggtttttaggagataattttcccgctaggcgccacgacggaacgggcgctacagaccaacccccctaacaagaatctcgaccccgagattcagcacctaagggagcagctccgggaactcggcgcggagaagatcttctcgctcccaggttgcctcatcttcagaatgattgctctattggactttgtagaacttgatggtcttctttcgagtctgacgttctgcctcttcaagaaccttggtcggtctttccttgtaagtcagattcttttccagctcgatattacccagagggacttgctcttctggaactcgaagacatttcttcaactgagacacgtgaaacacgttgtgcacatctgcgagaccttcaggtaactcaagctgataagccacttcgccacgtctggcggttatgaggtaggggccgatgtagcggggtgctaacttgccggacatcccaaacctcctcataccacggaggggtgatacccgcaggtatacatgatctcctttttcgaactcaaggtcacgcctccgattgtcagcgtaattcttctgacggttttgcgctgtctttaaacgttctcggattagcttaacttgttcttctgctgccttgagtatgtcaagaccgaataccagcgcttcgcccacctcattccagcacaagggagtacggcactttcttccgaaccattgcctcgttcggcgacatctgtatgctagcctgataactgttgttgtatgagaactccgcatacggcaaacaacgatcccaggtgccttcgaaatccaaggcacacgcacgtagcatgtcttctaggatttggtttaccctttctgtctgaccatcagtctgcggatggtagcccgtacttaaatttagatcggttccgagggcttcatgcaactgcttccagaaccttgaggtgaactgagtgcctcgatctgacacgatcttcttgggacagccaaatctacatacgacatgggtcatgtagagttctgctagtttctttccatcaaaggtggttttcactggcacgaaatgagctgatttcgtgagtcggtccacgattacccaaatggagtcgtacccgctaggggttcttggcaaaccggtgatgaaatccatcccgatctcttcccatttccactcgggaatcggtaggggctgtagcagaccagctggcctctggtgctctgccttgactctttggcaaatgtcacacagggctacgtattctgcgacatctcgcttcattctagcccaccagaaatatgccttgatatcttggtacatcttcgtacttcttggatgaatggagtaggcggactcatgagcttcctttaggatgagatctcttaactccttcttggctggtacacagatgtgtggaccgcaccaaactgtgccttggtcgtctatggagaaattggtgtctttcttttcctgtattctttttattaactcttttatcccttcgtcatctttctgagcctcccggatttgcgattctagggtaggctgtactgtcaagctggcagggacacctgactgtaccacggtcagccttaacttctccaattctctgcacaggcgatcttggtcaggccgtatttgagctacattgcaataggccttgcgacttagcgcatcagcgaccacgttagctttaccgggatgataatgaattcccagatcgtaatccttgattagttccaaccatcttctctgcctcatgtttaactcggtctgagtgaagatgtatttaagacttttgtgatcggtgtgtacttcacatctctttccgattaaatagtgcctccagattttaagagcatgaatcacggctgccaactcgagatcatgggtggggtaattgacttcatgaggcctgagctgtctggacgcataggccaccacctttcgttcttgcattaggacacatcctaagccttgtcttgatgcatcacagaagatctcaaaatctttttggatatctggcaaggtgagaactggggcagtggtcaacttttcttcatttcttgaaaactgtcttcacaggctgcagaccattgaaatttcctttccttctttaatagctcggtcataggtctggctagcttagagaatccttcaatgaatcttcgataatatccagctaagccaaggaagctgcgaatctctgacacattcttgggcgggttccaagcaagtacagcttcaaccttgctgggatctacttcgacaccgttggaggagatcacgtgtccaagaaatgctactcggtctaaccagaattcgcatttcgagaatttagcgaatagttgatgatctctgagcttttccattatcagcctcaggtgttcagcatgttcttcctcattcttggagtatatcaggatgtcatcgatgaacaccacgacaaactggtccagctattccataaagattttgttcattaagttcatgaagaacgctggagcattagtgagtccgaaggacattactgtgaactcgtatagaccataacgcgttgagaaagcggtcttcggaatatcttcaaatctgattttcaattggtggtaacctgatcttaagtcaattttttagaaaactcttgctcctttaagttgatcaaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttaccctccaattcttcgatttgtcttttaacttctgctaactcattagctgccattcggtagggtctttttgcaattggtgcagtgcctggcgccagttctatggcgaacacaatctctcggtctggtggcatacttgttaattcttctgggaatacgtcgggatattcacagactatgggcaccgactccaaggaggtgacttgtaaacaggttaggatagaccgacttgcggtaggggtgttagaggtaaagcggacttgctttcctccaggtccttgcaaggtgatggacttttcagcacaatctatctgtcctttgtgcttagccaaccaatccatccctagaatgatgtccaagctttgcgagtctaggactatcggtttggctaggaagtcaacttcctcaattctaaggttaactcccgggcatacttgagttgcccttatattcctcccaggggaatgtactatcattggtacacgtaaattttgggttttccaaccatttcttttcacaaaagcttgtgatatgaaagaatgggaagctcctgaatcaaacagaactattgcgggtacggagttgacagggaacatacctatcacaacgtctggagcatcctaagcggtctcagcttgaatgtggttcacccggcctcgaccaaagttgttggacgcacgagaaccttgtccacttgcctgagagctaggacgagactgagctgccgctggagtaggagttctggcagtgctgccattagcatgccctaagctggtgttggtaggattctgagggcactgtctggcatagtgacccatctggttgcaccggaaacactgaactgctgacggtccctgtggtgacttgaaagaggtaacactgtttggcgcagtattgccactaggggcacgctgctgtggctgaggtgccggacggttcatttgaggacgaggggcgtagcctggctggtggttagcctgagtgaccgactggtggtattgcatgggttgaccgtagcgagggcgaggtacgcctcgggaagaatttccctgatggttagacttgcgtttcttgtattcttcggtagcctcttttctggcatcctcaagtagaagcgccttgttgatcatatgttgaaaagtggggaaatcatgagcaagcaactggagtctcattccaactgcgattcctttcaagaatttcctgatcttcttcttgtctgtgtccacttcctcaggggcgtaccgagccaacttgttgaacatacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgcagcaggtcctcttagctggtgagaggcgtagagcgtcttctcgaccggagtacactgcactaagttgagttttctatcaacatctttcagccaatcgtcagcctcaacgggctcgatggtctgagagaactctggcggacgtgacctcagaaaatctgtcagcttggatctattgttgctcatgtgagggtggccatttccatgcgcattatgctgaaaaccggctacggctgcggctaatccttgcaagatttgtgtctgaactgccattaagtgttgcatgttgttttccacatgaggtgggaaagggaggcgttcttctccagaattgtgactggcagtgcggtgagagcggtgagactgttccatctctgcattacgggaaactgtgcgatgcgagcggctgctgcggcggggttgctcaacttctgcgttgcgggaagcagtacggtgcgaacggttgctgtggtgagactgctcattagctgactcatgattttcttctggctcaactctaccatcttcaaaaccaaagcgggctggtgcacgagctgcacggcgggggcggctagccatctaaactcccagaagagggcggggtaatagtcagatagcacttaggagggcaaggagcaaagtaaatagcaactcagatagcacacactaggcataaactggatttttcaaatcatagaaacacctaatacaacgggtggggacaaatcacaaaactaccccgagcttgactgcgcgcgccccccctaagaaaaccagactaccaaacaacacccacaacaaacacacgcacgcactacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctgacgcgaagggaccggcggaacctgtcgagggctggcagcagcacgggccgctggcggtgggggagctgggtagtggaaacggaacacagtggaagaaccaacaacacgcttccgcgcagtgcggataaagcgtgggccacggcgggtggaagcaactggggtgtgtccgggggtgtaggaagggctaactgggtgtgggtagggggagtacactggtgagtacggcgcacgcgagctgggggagcgcgggccactggaaggcgtggaagctgccgaaaggcggagcccccaagacggtggctgtagtcatgggccaggcgacgaagcgcagtccaggagaggtcctggtactcgatctggagagtgggcctggccacggtgaagtggtgtggacgagggccagctccgtgtatacctccacgggggtaaaggtacacagagagctcacagtgagggggaacacggtccacggagtaccccgtgtactcgggacacgagaagccaaggaaacgggcgaggtcacgaagctaagcgacgtggtgaccctcaccaaaaccgtgggagctgaagctggcgctcactgccatctacaattttgaaaaagggagaaaggatcagtaaccatttttagaaacaaactattgaaaataaagaaaacaaaagaaaccttagcttttcgcaagtagtttggaacttagtatccttagggtcgtcctaggcgtcgggtttcgtcctagggccaagcttgtgctctgataccatctcttgtcacgccccgaactagtaccgatcggaactagcccgtgacgctccaaattaacctgttaaccgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccagggcttagaccaaacatcacaggcgcgacttgggaactaggccgaaaccctaaaactcaacgtagccggcttgctcctggaagaactcctcatcagccggatccgcttcatcttcttcagcaactgggggggaattatttatatagagcaagggtgagtacgggagtactcagcaagccaagggaattaagtgtttaatgcaggcttcaagggaaggctgttgtttttgcaattgattttatttgaactcttttctgaaaacaactaagtgagtgcttctcaaacgactcggatgagacagagcgtctcgtccggtcggagtatgtatcagtctttagaattgaaacaaggttggcacccggccaacagcttttcaaacggccacccaagaaggcggcccaagtgcgcgcgcgcgggaggaaaggagagagagggccggtggaccgggctcaccgtgcgcggtcccgggtgggacccgcttgtcagcggctcggctcaccgtgcggagggagcacgcggtgcggcgctagggtggggaagggacgcggtgcatgcgcgcggttcgcggtggacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgccggccggaacggacggcggtcgacagcggcgagcgacggagcaaaccatggcgatacaggcaaaagcgagtacaccgggtggttgcacgtgacgaggggagacgagccaacggctcggatttgccgggggttgctcgacggcggcggattgcggcggcggtaaccggcggcgggagaaggggaaaacggcgacgaggtcacggggggctaattcctggcggcgagagcatctacgcggctacgggaatccgatgctagcgtcggattgggcggagctacgccgtgcgaggccgacgacgagcgggtgctacggagcacgggcggcaacggcggcgagcacacggcgagcgacggcaacggtcgggacggcgccggctaactacggggaggctactcgagctactaccgaaagctaagggggggagatggagcgaggaggaagaacggagggaggcactaccgtgcgggacggggcgcagtgacgagaggccgacggcgcgggagtaatctctccggcctcaggccggggaagaggaaggagatggcgcccccggagtcccctt

SEQ ID NO: 69567 - DNA, 55642 bp, Oryza sativa
agggattcggcccatcgaacccgggggaggcaaactagacttttgggagggatttgatttggaaggatttggattcggaaatgaacttgacgatagatcggggattgagatattgagatggcacggacactagacaacaagcaaagaaacaaatttcgcaattagggtttttaggagataattttcccgctaggcgccacgacggaacaggcgctacaatagcttgagctctagaggaagcacagctagggtttcccaggagctcaagatctcttgtaagaactccactataattcctcgcacaggagtaggttgttacgcttcccagcggcccgaacctgtataatccctcatcttccacacatattcgcaagcgatctagtagccagaccctaagcgaagatacgctcttgatcatcgcgccttatcccccggccgaactcacaaagggggggtctcacgacctcccgctagagaggatcactcctcgacacccttgtttcatattataagtcgtttaatttttttactagtcaaactttgttagatttgaccaaatttataaacaaaatttagtaacacttaaaatattaaattagtttcattaaatctaacattgaatatattttgataatatgtatgatttgtgttgaaaatactgctatatttttctataaatttggtcaaagttaaagaagtttgacttgaaaaagtcaaatgatttataatatgaaatcgaggtagtaatatgtttaactacacatgtgttgcatgcaatgatttccataatatgtacaaacttgaaaaggactatttggagtgggaaggattgggccagttgttagtcgggatcagggtttcccaaaccgccggggacggggttaccgcgccccggcggtaagcacggttaccgcgcagttaccgcggtaaccgtgaaaaaccgttcaaaatttatcaaaaattcaaattattttttaaatttatttaaatttaaggaggttaccgcggtatttatattactgtatcccgcggtaagcctggtaaccgtggtaaccacgcggttaccggctgtaaggtgaaccctggctgggatatccttatctcatgaggaggatatgatcctatggcccctggaaaaaaacagaagctattctacaaaatctttgtatgatatgctctcttttcattgtgttagggaccttagagggatgaaaaaaaaaacacaaatattaggaaaatacctaatattaaataaatagaaagggtgagacttcgaacactggccggctagcccaccatcttgtggagctagctaaaagatcccttggcgtttctctaaccttagagggatggacatatggaaatcgccaatttcactgaaagtgaatcactttgtgtgtcttgcttgcttagatagaattcaaactaaaaagaactaggaaggctctgagagatgtgttgtatgtaatgaggtggaaactgttgatcacataatctttgcttatcctattaatctcaatttcaaattattgtcctagtttaccgaccgtttatgataatcgaattttacaaacgaacatattattcacttgtcagcatggacatagtcctcgaataggtgttttcgactaagttggcgagccagcgggaggcagtgaagcacagataaagcaaacatatataagtgctctcttatacagccatgtcatcctaccctgaatcatttttctcaaaaattttgttatctcagctttgtatctcctttaatagacaaattctcaattggtcagtaggggaacgaaagaatgcacggctagcttctttgataattcagtattcaacaagaaattctagaatcatatatattctttttttttcaattcgtgtttatcgagatttatatcatagcgcaatgtcaccagggtaaaccatgagatttaatttcttgaacacatcgatcatttattagcaactatggttggaaatttacaaatagacttcaataattgtgatctccttacgttaggctgctttttttgtttttctagtgttctattcttttagatttacactacgttcatgaaaactactatataataattggctgtaactcttttgagtaaagaccgagatattatattccattatcttaaaaaaaaattagcaactacgagaagagacacacaccaatatatatcacttgtcagcgaggacatagtcctcgaaatagaaggtcttctcgatgaagccggcgagccagcgggaggcggcgaagcacagcaccgccgcagccacgacggcggctctctgaacacccgacgtgaccaccgtccccttgccggcggcgaggaacccgacgacggcgaccgaagccacctgcagggcgacctccagagctctcatccacttcagtgcagcgctgcagctcgtgcactgcatgacatgcgaccagtacctgttcatatctattttagattcaagaaattttacggtccttaaaaagtatctccaggtacaagtacaacctttagattaacactgaattctcctatggaaattctatatgttttaggtcgatcagtgtgactgtgtgaagatcagcagactagcttgttaatttacctctcgtagacctcaactctggtagaagctggtggcagctgattaaccattggggttaaccagccaacctgattgttacagtacttcttgaaccagtttctgaaggcgatgatcaagttgtcagatgatgtgggcacgtagcatgctttatgccagttatcaaggccaaacgcggcgtaattacgctcctgcagaagcatatatattgttcaggtcaagtaagatctgagataatcgattgcatccatgcaaccacatacatagctcgaatcattcagtttgagctgaaaagagaattaaccggtcacctcaatatgaaggacagacgagtctgaatccaggacttggttcgtcttaatatgcaaccaccaacgtggtatcatcttgtcgaaccagccatcaagattatacccgttcgcccagatgaccctgcatcttcccggagacaccgggatgcagaagaacactgtcccctgacctcaggctgcttcttgttgttggtgttgttgttgtcctgatcaacctgcagctagcacaaagtgtaatcttttcaacatgattctttgagcttgtaacagtggctgcaatatggcgaagtgatcagaggcagataccactggcttagcacgaaatggcgagcctatgagagtaaccggcgcgatgaacttgaagtagccccagttctcctctgggttggaatggaaccctgcgatgttgagctcctctatattcatcttgatcgggaggccaccttcctggtcaaattcaactgtggagaggagatcaaatgtttcagaatcagtaacgcagcttagcattgagaaattgagattaacacggcattggctcaattaacagatcgtgtcaacgcagatgatgaggaacatatctgcctatatcttcctccctggggacatgagggaattggcccctgtgcgcgtagggaacgtgagcagggtccatgaaattctccaccaacaactcgtatctgcattggttcgattcggatttcagaatccatggcacatacatacatacatacatacatacatacatacatacatacatacatacatacatacatacatacatatacacacacacacacacacacacacacacatacacacacatacatcgaggcatcgagctgcttgtgaatagcttgtaaataatttctgtacccgtataagaggtctctgacgccggagttgatgacggacgacgggtcgtcgagctcccggatgtacggcggccgcttcctctgcaggatctccttgtactccggctccgatctcgggtagaaccacaggatgttgttctgcaccacgctcgggtacgacgccacgcacgccttgctattcttgtgcacctgccattagttgatccaagaactcggttaattaatcttgagaaaatgttgatgtttttttaaaaaaatttgttttacaggagggcctagggcgggggcctgggggatgaactggcaggagccgtggccatcgaagcaccagccatggtaggcgcactggaggcagcccttgccgtcgacgcgtccctcggagagcggcgcgaggcggtgcgggcacgcgtcgtccaccacgcgccactcgccgccgccgccgtcgaaccacacgacgacgctgatgcccatcaccatcttcccgtgcggcttgcgcttgtcgaggtcgcgcaccggagccaccgggtaccactggtccagccagtcgaaccgctcctcccctgccgccggcgtctccttctcatccacggctcgtgggagcggcgcctcggccgccactgccgacaccggcattgacagccgccgccgccgcgcgtcggtggggctgatccactgccggcgccatggtggtattcttggtgtgctcgggttggttacagtgtcgcggaagggaagcgaaaggcgggtgagcgagagcaggtggagggagacaggagccatggatgattcggagtgtggagtgtttagttaatacacgtgagtaggaaaacagatccctgactctgtgtctgtgcagtgtgcagtcgtgccactgacatgtaggccccatctaagatccatatatcagtgatacaactatacactgtataatttcaggggagtctcatccacggagtagtgactaagcaagacatagaccggaaacataaacgaatgcactgtatattttttcgggaaacggaaatggggacctacagcccatattgctctacacctgctacaatggttaacactggcgtagggtctatatattttttttataatactatttctgaagtagacaaacaacttttgaaagcgtgctaaacatcccaccgtagcaaattttttaaaagttgtgatagcaaaaagcttttcttactaaattcttactaacgctgataagtcatgttatgaatgcatctatattttttataatttctatatatctaaatcaaacggttgagataattgttagtacaaatttagtaagaaaaaattataacagtgctctttaagatactagcgtactactccttttcaaaatagttatctttttattcaaaatttattctaaaatatttgttactacttaatccatttatcacctctcattcaaatttccctctattttacccttaactgccactctaatcccaatcatgtatcatttaatgaaggatagtatgtcttttatttaaataaaaaaattaccaagaataacaagtatttcagatggagggctagttagttctcttaaaataattgtagattttaagccgtgtttgatgtctaactcggaatctggctgaggcaggagctgttgcctcaaccacaatgttattgtaccttacgtaacgtgcttttctttcgtttttagtaaaaaccggccagtgtttcttccgctaacccaagaaaaaaagttaatttaattataattttcatgtcattgagtgcattaaatttacgtatttttttactcatataatggctatgtgcatacgtgtccttaaatttcaagactattaccctataaggcagtagtaaggaaaacaaaaacaaaacactaccaccacacacactcacaacaactacacacgaccaagaaaagagctaacaccacatcggtcacagctagacccaacaaaggagctatagctaaatcgcccaaaatcaatccctaaaaaatgagtaccaagccagcaaggtgacaacggacgaaaaggtagtagagggagatagcgagagagaagaaatatccctttccctcgctcgaacccgtcgactcgttgccacttaccagattcgcacaaactgtctgagcacggttttggcaaaagagagtctcctagacgacatctccatggagaaaagcgatgaagagcaccaccgctatccatcgaggtctctaggagatccaaggcaaggttctcacccggcaaccccactaaggagggagagggatgtctcaacaatgccccaaagaggataaacgacgcccaaagcgtcgtagttgtcagcctcgtaaaactgggctaggcttacacctgttgcctatccctgttgacctgcaattgtagttccattgctccaccaccaaccacccaacattgttttcaattatgatctatctatcctgccaagttctacgcgagaacaacaatagcagcctatcctctatcttaaaatgttgcaatctagaatgagatttgacacatcctaaaacaacgaatctggacaaaattctatccagattcgttgtcctaggatggattaaataaaatctcattctaaattacaatatttgggatggaggtattaatatccaacatgtttgtacgattatattgacacgtactatatgcacacattttattggatttcaatgacacgatatataatccaaatttacatataattatgaattgacccatgtgacatttctctaggattattgagattgtgtcctcaccttacttgacgtgtaacattggatctatttcgttttatttccatatctcaaactcttttattgccaagtattctaactctacaaattcataattttgaagctgtgattgcatccatttataacataatgtttcaactaattgtttcgttctaatatttgaggaaatataaaattttaagaacattataatctaagttttaaatccaggaccttaggagctaaaagtgggggcattcaatgttatgacatccttaaccgtgaataacatacaatttaccattctaacccatattcaataatttaaatggtcccactcggtgacggagccaaaatggtttttaagctcagacaaactttaatataaattgtatttgctataaaagttttatcattaatttactcattaatattaaaatttaatggagttttggtcggtgagtcctggcagccgtccgagctaaccggacgatgtctccgccactagtcccactgtcccacaaaactaatcagatcgctgccacgcgtcggtgctgatctaccaccgactccatggcccatggcactagtctgattgaatgtgctcgatcggcgtggtgtcattgtgcaatttgtgccctattttttgtgcatggtggagtaacagtcaccgccagaaaccttcaaaagcgtgtacagaagcaccctgggtactgtacccaccccaccacatcgtgagcttttcaaaagttgtgatagccgacttatccttgcgaacttccaaaacagatacatagttggtaaattttaattgtattttttatgccatttagttcattgtttatataattttgcgttgatgacttattttgatgaccatccgaatatgagcaattttaccattcaacatttagtacttcgaggtaccaaattttacattagatagtactttgagaactaaaaaattgtggtacctcgaggtaccaaatgttgaatgataaaattgctcatcggaatatatataatttaatgaactgacacttggatatcataatatatcatttttatacgtcactagcaaaaatgtttatgtgttaaaacaggtgaagataattttcacgattgataaatttttttgtcaaacaatagcaaaacaaatttagaaatcatatataacattgaatccggttccgctcttcatgcatcatcacacgaagaatagcttatatacacatttccaatagcctcacaaattgatcggatggttattccataagttgacacatgtggattttattatacctcatggtccaaagattaaaattttgagtattcaattagtaaaagttttttcccgtaaaatttttttactgtagatggaaggcatttgcaaagtaccaaacttaatgcatacaccttaacaatgataaattcaataggaaaataattgtgaggagagaaatttggaagagaaaaaagagaaaagaaggagatggagagaatcatgattattgagggaaaagaaaaggagaaaaagaaaatgaaaaaagagagaaaaaaaaaagaagccaatcgaggaagggtgtacgcagcgccgtctagtggaggcgtgcgggatggtgtgggccatttgggttgggctaggagggagagagaatgaactgggatatgggtgcataataattattctagactcacgtcaaattggatacgtgtgacatataactaactcatcaaacacagacgacgtatcaaagcgccgaagaaaatattttcaatttttgtaatattaaagatagacatagagataaatattgtactctttgaccgtgtcatatggagcctttttcatattaactagctgggtggcccgcgcaattgcgcggctagcaccgatataaaattatctattttttaatatagttttacttagaattttgttaaatagatatctcgttgtcttaagactttgaaaaaccaaaccttatcatccttgtgtttctaattttatattttttaaaagttatgtcagttgctactcctaaatattttgtcacccctcgtttatttgcttcctcgatctaccactacttctatttgttctcactaaaacctctaaaaattagaccttatagtttttagagtttattgtctcgtttgggttttgtttttataattttcagaagtctcgtcaaatgttgccaccatactactctacggtcaatccactgcctcttctctttatttttattgggattttaaaaatcaaacgtaattatcatttaggttctttttttactttctagaagttccaccaaactgtcagcgactttaccactgtactcatgtacagctcacccgctgccccctctttattgtctttgagattttaaaattcgaacatgattatcattagggttttttttttttactttttagaagtcccgccaaccgttgtgaccatgctgcttaatgacccgtccatcgtccctccttttaatcatcattgggattctatttgggggttttgtttatagtttttagatattccatcaaccgccaccactctaatcctttacattcatgttgcttctcctatatttgttgtcatttgtcatctttttataatttttagaagtcatgtcaaaccctatcaccatacttctcttcggcctgtccactacctcttctttttattgtcattaggattttaaaaatcgaacataattattattttggttcatattttactttctataagtcctgccaaccgccatgaccgggctgcttaacggcccatccgtcgtccctccttttaatcgtcattgggattctatttaaggttttgttaatagtttttagatgtcctatcaaccgtcaccattctacttctttataaacctgttgcttctccccctctttattattatttgtcatcatttgtgttctagatggagttttttttagaagtccatatttttcattctgatatttttatttataaattatatttctacttgaactcttataattatttttatatttacagaatttatttttttgttatttcaaattttagttaatctcgtcatatgttctaaatggtctcttatttcaatagtttttactttttatgacgaatttaagttatttataaattgtattcctagttgaactattatttttatttttctatttttggaatttattttaatttttatttagaattttagttaatatcgtattatgtcttatatgaattatttttttatgttttttaattttcaattttatagttgtttcatcctactcaaactatcttttttatttatctaatttcagattttattttatttttattttaaattttagttaatatcgtattgaattcttatatggactcttcttttaatatttcttatttttaattctgtattcctacatggactcttctttttaagattttattttatttttattctgaattttaattaatctcgtattggattcttatacggacttttctttcaatattgcttatttgtaattccgaatttcagctatttttaaattgtatttctacttggactcttcttttctttttctccgattaatgtgggaatttctagcccccgcagcaaacgtggtgccttcttttcgagctgttttaataatataatataatagatagatagatagatagatagatagatagatagatagatagatagatagatagatagatagatagatagatagatagatacttgtttttcttttgtaagctagcatatatagggatcgaactccactcccagattttcttagacactgtcacttgtaagcatggacgtagtcctggaagtagaagctcttctcaatgaagctcgcgagccagcgggaggcggcgaagcacagcacggcggtagacacggcggcggctcgccggacaaccgacggtgctagactccccttggcgacggcgaggaatccgacgatggcgaccgacgccacctgcagggcgacctccagcgccttcatcttcttcagtgcagcgctgcagctcgtgcactgcatgacatgcgacctgtacctgttgatggcaccagagaattaattgatcagcatcacagcagcccacaaattctgaatgaaaattttcgatgaagctgatcttgtaacgtgtttcgggtcagtgtgaagatcaacttatcacctctccaagacctgatctttggtaggagttggtggcagctgattagccattggggttgcccagccgatctgatgcttacagtactttctgaaccagtttctgaaggtgatgaccatgttgtcagatgatgtgggcacataacaagctttgtgccagttatcaaggccaaccgtggcgaagttgcgctcctagagaatgaaaatcttcaggtcaaaacatatatatgggcatagtaagtcagcaggcataatagctcacatcgccttctgtgtgtcttagaatagaaaccggatatgtaatccatttccgttatctaaaaatgtactcttttaaaaaaagagaaattttatagttcttaagaagatatcatgaggtaccactttttctattataaatttggtacctcatagtaactaggtaccaagagataccaaattttatactaaatttttttacatcatggtaccttcttatgaaccgtaaaattgctcttaaaaaaatcttgtgatgaattgtgaatctgccaccaccctcaccattaacttcctgatttttgaagttcaaaaaaaaaagagtgtgggaccaaatggtctacctattagctgaaagatacatgaatagaaaaatagataagatatgcagaatgagatggaaaaacggattgatgataatgttatttttttttaaaaaaaagtaaaaaatctgtcacaatgcatggacaatatgctagttttatcatgaatcattcagcttgagctaaacaaataggtcacctcaatatggaggaggtaggaatctgaatccaagacgatgttcgtcacaatgtggtacaaccaccgtggtattatattgtcgagccacgcatcaacattccgcgggaacgcccatatcaacctgcttcttcccggagccaccgggacgcacaagaacaccgtcatcgcctcaggttgcttcttcttctttttctccttgccctgatcaatctacacaaaatctaaccatttaatacgattatttgatcttcaagccttgaactagggacagatgtgccatgggggtggtgagggctcaagcccccactacccgtattgatactttaggagcctccactaaatccccttaattttacatcctgatactttttcaatgatgataaaattacgaacatctttcccatccttgaggaggtaccatgaggtaccaatataatctaaccgttgatttagaaggggtatgatggggctaaataaatttagggtggcgctaatccctcaccctcttgatggcgttttgcttgcttgctcgtggtggctcaaagggacccaaccatgtccgccgctggcggcggcaagagctgcatgggaggaggcgaggaggcgattgccgggctcctcgacagcggcagcggcgtctggcgagtacacgctcgtgacgacgagggcgacaagatactcgtcggcgacgtgccatgaatgaatgaatctctcgtcttctccaaatctttgccacatctccgtgccggcgtcgcatcgagtccgctgctgccgccgtcgcgtcgcatcgagtccgccgcggccgccgtcacgtcgcatcgagtccgccgcggccgccgtcacgtcgcatcgagtccgccactgccgccgccacgtcgcatcgagtccgccatcgagtccgccgtggccgccgtcgcgtcgcgtcgcatcgagtccgcagcggcagccatcgcgtcgagcttccgacgaatcgccgccgtaaccatcgtcgagctcccgatgaatggccgctgcaaccatcgccggccttaccctcttcccctctcttccctttgccgcatctccgtgccgacgtcgcatcaagttcgccgcggccaccgtcacatcgagcttccgacgaatcaccgccgcaaccatcgccgtggccgccgtcgccgatgaatcgtcgccgcaaccatcatcaagctcccgacgttgcagctatcctggtcctcccgccacccatcgccgatctgggccgccgccgggtttccgatctagggttcgggacctatatgcccctgctcccgccgccatctctcgccgccggttagttcaacgctgctcctgccctgtgagatgcagagacggaggaggaagagatgccgcgtgcgtgcgtgacgcggaataaagacgaaagtacaaaactgccctcccacccacggtaccgtttcaatgggtaggtgcggtacctcatggtaccgacgatttttgaccgtaggatgttgccagatcaacggtcacgatttggtactgcacaaccttaaagacagtaaaaaatctctaaaattacccaaaacttcatctagtttatttagcctcctctagtatttcttctttgctccgtaatggcaaagtaagagggtgctagggggcagatacctgtggttctttggtgcgaaagggcttgccatagagcgtgcagggcgcatcaaacttcatgtagcatacgtcatcctcctgtaccgacaggaagccgtcgatctttgcctgctccgtcctaatcttgaccgggtagcctccttcctgatcggactcaactgtggagaggagatgaacagttgaacactatcagtggtaggtgcagccggaacattacaaaatggcactagctcagtagcatgttcatgcgtgcagtagactgaagaattaaaactgatcatgtcatgatagatgatgaacatatctgcctggatcttctttgttctgtatgggcatcagccccttgtgcgcgtatgggacatgagcagggtccataagattctccaccaacacgtcgtacctacattacaatggagctagctaagcaaggtaaaatatgtggtggaaatgcagtggaaacctgaaagtaatagttggttcgaaaaataaacgtatgagatttgtccacgtcatcacggataaaaattttactcgcagattcactcatgagttaaaatttaactcctagtaaaattttaagattttaactcatgtagcacgttttaacttagacgtcgaattttaactcatggtgacatagatgaattccagatgtccatttttcggtccaacggtagttttcaaattttcactatatataggctttgcaactacatattttcccctaagcgaatgatcgagctgccatgctaatgggggagcaagaaattaagatttaggagaaatgcttggagatttctgtacccgtagaagaggtccctgacgccgaagactgtgttgaaggacgggtcatcgaggtctgggaagtacggcggccgcttcctctgcaggatctccttgtactccggctccgacctcgggtagaaccacaggatgttgttctgcaccacgctcgggtacgacgccacgcacgccttgctgttcttgtgcacctgccattaattgatccaagaactcggttaatcttcagaaaatgttgctgtttttttaaattttgttttgatttgttttacaggagggccgagggcgggggcctgggggatgaactggcaggagccgtggccatcgaagcaccagccatggtaggcgcactggaggcggcccttgccgtcgacgcgcccctccgacagcggcgcgaggcggtgcgggcacgcgtcgtccaccacgcgccactcgccgccgccgccgccgtcgaaccacgcgacgacgcggaggcccatcaccatcttcccgtgcggcttgcgcgggtcgaggtcgcacaccggagccacgggataccactggtccagccactcgaaccgcccctcctcgccgccgcccacggccggggcggcctcctcctcctcctcggcgcgcgcgtgtggcggcggcgtctcggccgccacggccgacgccggcattgatagccgtcgccgccgctcgccgctggtgtgtttccactgttggcgccatggaggaggtagcctgaccgtgctcagcttgacgccggcgtcgcggagcaggagaggagggcgagcgcgggagagcaggggaagggagaccggagccatggcgcttccgagggggagcttaagcgcgggacatcttttttaaagtggttacgcagaccatggccgaatgaaacgtgctacagtgggtaatattgtttcgtagggtccataagaggaatcatgctatcttttatttctgtatgtatacctattttttagctatccatgtgttgcgtgcaaatgatttctataataactagattacaaacttaaaatagtacaattctttttggaaaacgcaaacatattttagattgtgttggcaaactgagttgggaactaatagataccttccgcatgcaaaacatagtgactcattagcgtatgattaataaaatattagctatttttctaggacaacttgtcaacgaacaaaacgatctctttggacctgcactagagtaaagcaaaacgatctctttggaccttcattatttatatatcatccaaatggttatgaacaactagatagattaatatggaataaatcatttttcacaacacatgcaggttcaaatttaacttctacaagttgcaacgaaaaatacaaatttaaacgtagacatagtttaatttgtctgtttttgcaactcgtagagttgatttttaacttgcatatgcgtccagtgatatatcatatattaatctatcttgttatttttctttattttttccataaccaattagatgacatagactagctaaaaaaaatgtcgagtgttttttgaggggaaaactttcaaatctaactatagtatataatttcactagaactatactataataataataacttatatatatgtattaaaataatatatataactttatatctaatttatatagagataacaatgtagttataatgtagttacactgtagttacaatgtaattataatgtaattatagtgtaactacgatgtaactagcatgtaattggaatataacttagatgtaacttgaacaaatctaccataaacatgcgatgatgggactagcttgtaaaaaaagggtttagatccaatagtaaaatatctcagcacaaatcttagagcggaattgacggccaaaatttttttttgacagtcatctagcagttccgtataaataacggggagagacttttcgaaaacgagactacgctcagtcgttttcattctaggcctcccctaagcccactcaacatccagcgtcttcgtttctccgacacgtgtgctgccgaagacacaaaggcgatttagatttttttttataagaaaacatacatcagcaatgaaaaggaagagtgcataataacaaactggtcagactaaattagagttcaatcaaaagaagatcgaataaaatcaaacgtcagactaaattagagttcaatcaagagaagatcgaataaaaccaaacgtttgcaggtaagttctctcaatcaaaagcatcacccatttcacatatctatgttaaatcatgaaagaaaccaaagcatcgggtcaacaaaaacggttctaaatttttagttcagtggttatctgcaactttcatgtcttattttacttccaataatgcatcgaaatgtgaaaagaaaaaacaattttagtgggaacactgatacagacgctccattccccatgcaaacaaatatagagttttacatttttttttagataatgggcagcgtccggcctctacatcataagatcataaggtgaatacacacggccagatttagagttttacatatgtggttttttttttctttttcgttggacgccgatcgatcgaccaaatttattttccacagcattaaaactcacagagtttactgggcacatcgatcacttgtaagcatggacatagtcctggaagtagaagcttttctcgatgaagttggcgagccagcgggaggcagcgaagcacagcgcggccgcagccacgacggcggctctctgaaccgccgacgtgaccaccgtcgtccccttgccggcggcgaggaacccgacgacggcgaccgacgccacctgcagtgcgacctccatcgccctcatccacttcagtgcagcgctgcagctggtgcactgcatgacatgtgaccagtacctgttgatggcatcgcaagaatccaattttgatggtcactgaattctcttgtgttaattttgtgtttcagatcagtgtaaagatcactagatcagcagatttctatactacctctccatgagctgatctttggtaggagttgttggcagctgattaaccattggagttgcccagccaacctgatgcttgcagtactttctgaaccagtttctgaaggtgatgatcatgttgtcagataaagtgggaacatagcaagctttctgccatttatcaacgccaaccgccgcgaaattgcgctcctggagaaggattaattcgtcaggtcaagactgaacatatcacatatgggcatataatcaaggcagtttgatctgaagaaatgggtcacctcgatatggaggaggtacaaatccgaatccaaaacggtgttcgtcaccatgtggtgaagccaccgtggtatgaacttgtcaggccaggcgctgacgctctgtggaaacacccatatcaccctgctccttccaggagccacagggatgcacaagaacaccagcatcccctgaggctgctgctgctgcttctcctgatcaaaatctgaactttttagacggtttttttagcctgaataatgcaacggatcgagagggtggctgatgctgatacgtgccagtgtctcgaggggcaactctgaccggttgatcgtgcacggcgcgatgaacctgaagtggccccaattctccccctggattgacaggaacccgtcgatgttggcctcctctatcttcatcttgaccgggccgccgcgttcctgatcaaactcaactgtggagaggagatgaatgttctgaatcagtgacgacgcatatgagcattggagaatggcactagatgactaaactgaagaaaatttgggtagaaaattgattgatcatgtgatgagatagaacatatctgcctggatcttccttgtcttggaactgagggaagagccccttgtgtgcgtaggggacgtgagcagggtccatgaggttctccaccaacatgtcgtacctgcattgcaatggagccacggcatagtatatcaagctgcatgcctatgtgtccgtttcggagaagaatggcttgagcatttctgtacccgtaggggaagtccctgacgccgaagacggtgttgaaggacggatcatcgagatctgggaagtatggcggccgcttcctctgcagcacgtcgcggtactctggctccgttctcgggtagaaccacaggatgttgttctgtaccacgctcgggtacgacgccacgcacgccttgctgttcttgtgcacctgccattcatccaacaactcgataatcctgagaaattttgctttgagatcgacgcgggaatgtagattagatcgacgagagtagtggggctctgccttcaccctcccaatataggagcagtgtttagcatccgttatctattttttttctctcttttttttccctttcccttagcaatgggtctttcggggcggttgcgtgtaactaaaactctgcttcttctaatatattgacatgtaattctttttatgtgttcgtgaaaacaaagtttatcgttaagagaatgtagcaaaggagagtacgggagggccaatggcaagagcttcggggataaactggccagacccatgttcattgaatcaccaaccatggccagcgcactggatgcggcccttgccgtcgacgcgtccctccgacagcggcgcgaggcggtgcgggcacacgtagtccacgcgcgccactcgccgccgccgtgtaaccacgcgacgacgcggaggcccagcaccatcttcccgtgcggcttgcgcgggtcgaggtcgcacaccggagccacgggataccactggtccagccagtcaaaccgctcctcccctgccgccggcgcccgcacctcctcggccaccggcggcgtctcggtctcggtctcggccgccgatacggccgagaccgacgtcggcagccgcagcgccacgccacggccgatccacggccgacgcggtggcgccgctaggctagctattctctgactggcggcgccatcgacacggaggggaagcgaagcaggccgcgcgccggaacggaggaggagggaaaggggagccatggctttctttcacgttggcaacacagtgtgcgcgtgtgtgccagtgtgcatggctgtttggactttggatgtggcgcgcgatgttaaatatttgaagctccaggtggttcttgtagctgtagcctgtaggttgaggtggatctcgcaacaaattgtacagtctacagtaccatgtatagtaagaatctgcctgcccatccacatcatcatccaactatcctatccgtcggatgtcgggttgtatgtggcatttttttttcttggaccatatgatgcttttcttcacgtgctagctagtaggagtgaaaatgtaggaacagggtttacactttcctaaataaccgaaaattagtgaatttcggtactttcgaaactttttgtatgaaattatttaaaaatctaacaatttttttactgaatttgaattaattttgcaagttaaaaaaggtaaaattcaaaaaaattggctaggatagttgcttgccggagggggtccgaaattttaatcccttaatttgtataggaaaacaatctcaccgtgaccatacttttttctcacaagggtaaaataaaaggcaaaggtgatatcgaaactatagtgaacgaaactattcgagggggaagcacatcgatattgatcagaaactgacacttcatgagcaaagagataataagggccctttctccttattactttcatgtattaataagaagagaagaggtataacaatcaaggaagatcgttgtgttgtatgttgtcaaactttggaagatggcaggcatctttctttgaagggtagaggaataatagtgtgctactgtgttgggaatttgcaaatggaggatattggatcaaatcacctctgacctctgttaacaataaaataatagatattctagaagctgacaaacaaacaacagttaattactccctccaatctttagtgtaaaatgatattgattttaggatattacgtatgactatccatcttatttaaaattttagtgtaaatatgaaaaagtcccttctaaaaaaatatgaaaaagtataaatcatgttaaagtatttcagatgataaaacaagttacaacaaataatatttttaattagataaatgatcaaacggcttgtttaaaagttaatgacatcataccatgagacacggtattgtatttatggttgtaatgtgataagaggaacaggatatgtgagttcagagagagaaagaaagacggctacattgtcccaatgctatgtacaaactattttaaactctcgaggggacgtcccctcgttgtttacatgtcactaaaatggttatgaaaaaaactaaaaaaagttctacaacatagattaatatgcgatacatcaatccacaaatatgtaaggtaaaatttaacttttacactgattgtgaacatgtgttaactagttgtagtttgtttttttttttttgcaaagtgtagaagttcaatttaaacttgtatgtttgtgaaatgatatgccatatgataatacatgttttcaattttttattttttctataaccatttaaattacatgcaaacaacgagtgtacgtcctctcgaaagtttaaaatccactcctacacttaaaaaggcagtcctagccaacagtcaaaatggtcgctgcaggagggcaccagcaccaacctgaaggcaaatgtcatcataggataggaaggatatctagttacctctaacctctggttgttggagagtcatataactcgaaatggagctggtgaaccgacgaatatttggtagtgtagcactgtagcaagtcaatgttcactgccaaattaggacgggttattttactgtctccggtttttttcccgattccgcaagaactcccttgtccccctatcttgctatggaacctttgagaggtgatcatgtatcttttatatccttcttaatgaaattggcagagctcctatccttccccctcaaaaaaaaatatacgtatatgtgatatggaatagagctcctgtccttccccctcaaaaaaaatatacgcatacgtgatatggaattctcagggccctttctaaattgattagccgaacgttaaaaaaaagtaattatcatgtgattaatcggatatctatctatctatctattatatactaaaagttcattaaacatcttataaacactcctaagccgccaagtggcgctctaataaattagataaattcttagaaattctaagaaaaaagcaaaacatctagcccttggatttcacttaaaccggtggacccattattttacaccgtaagattagatttgtgagaaaaaaaagttaattcatctgtgatcctccttgcctgctattcgctttggatctataaaaacgtaacacactccacgattcttacacgtgatggggcatcagttaatcacaaaccaacgcactcctccaggtagcagggttctgcacgcaccatgaaacgttgactaggtacgtcaatctctttcaccggcgatcggcctgcccagctgccctagatgatcggctacaagggcagccataaccatgagtccgttgatgtcgaccagactctcgcgtcccccaacctctaccactccggcaatattttatcaattaatatttgatccaaactgaaatttgcaaactattgttgctgtttttttaaaagaaaatttccgttccaacttccaagttttttcatgtttctgatatgaaacgacatcatgaacttccaaattgtttctttccatgttaatgatatgaaacgatcgacatcgtggtcattcagtaacctaacaaatttgcactactgtatataagtaataaattgtgacactttcttattattactaattttgaagtttgcatctatttaagtggcaccaaatcataataacttactaatggttaattttaaaataagttctcaagttgataaaatattactgttgagagttacagatgagcacaattttatttttatatgttgtacttcccaaacgataaaatcatgaaaaattaaagttgtaactccaagtagagcacataccttttatgaattattttatcattagaaaaaaaatctaaaaattataactccatgcaaagatgactctagatgcattaactgttcaagtcataactctacatgtataacttgatatttactactcccaccatccttcctccatgccagtttgatctcatccaagttttttatatctccctaaaataattaacatataacaaatgacttttcgtttatttgtgtaaagagtaaataaatgggcatcgttgaataagctcatgcatgcaactaaccaaaattactttctattggtgtaaccctaaaaaaaattctcttggtgtaaactccacgaaatatttacagcgtgatgcaatcaacaccttgattgatgaaaataattttagaaccatggaggttttgttgtttttggtctcagcatcctttgcttaggtgatgatcaaattggaatagagggagtaatttctaagtcagaaatattctgtcttatttgtaagtgacaaattgcatcaatgtaaactgggctagcttgatgccaaataaaacacatgtgttagtagaaaataaacaaatttaataaaaaaaatagttagctcctaaacatttttttaaaaaaaaaccttatttttaattcacatttagtttattagatatgttttctaaatagactaagtcaacactatcttagatgatgaagaaaactatagggatgaattaaatattatacggtataaatctatcaaatagattaaacaattattgaatgcgcgggctagcttccttgttaattattaaaaacttaaaaaatagatttatttgatttttttaagcaacatgtatatagaaaagtttttgcatgaaacatataaaaacatgctaacaaaaatcaaataattagccaagctgaaattaacgtagtttagaacgcgcccgaaatttgttttctccatccatttgtttagctgcatcctatgaaatcgtcagctaactcttaagatgatcagttgtttatatacagatgctatcgatatcaagcatacttggttgtgttttctatatacatttttaagctgctaaattagaagctaaggaattcccagcaacaaagaactctctgatttcctggacgcatcgacgatcacttgtaagcatggacgtagtcctggaaatagaagttcttctcgatgaagttggcgagccagcgggaggcggcgaagcacagcacggccgcagccacgacggcggatctctgcacaaccgacgtgaccaccgtccccttggcgacggcgaggaacccgacgacggcgaccgacgccacctgcagggcgacctccagcgccttcatcttcttcagtgcaccgctgcagctcgtgcactgcatgacgtgcgaccaatacctgcagacggcatcacaagaatcatttgaattcaaaattcaaaagaagaataattgaattctcttgtgttaagttttgtgtttcaagtcagtgtgcaagagcagcagactgatgcaggtagattgtttagctgtttacctgtccaagagctgatctttgctaggagttggtggcagctgattagttattggggttgcccagccaatctgatgcttgcagtactttctgaaccagtttctgaaggtgatgatcatgttgtcagatgatgtgggcacatagcaagctttctgccagttatcaagaccaaccgtagcgaaattgcgctcctggagaaggaataataatgcttcaggtctagaatggcataacacttggcctgaatcattcagtttcagctgaagaaatagtcacctcaatgtggagcaggtagatgtctgaatccaagatggcattctgcccaatgtggtagtaccaccgtggtatgatcttgtccatccagacgccgacgttccgcgggaatgcccagaccaacctgctcctccccggagacaccgggatgcacaagaacaccagcatcactgtgggttgcttcttcttcttctccttgccctgatcatcctgtacagaatccagcagcaccaacaaggtaattgacaatactgatcttgtaagatggttctatgagcttgaacaatgcctgagatggagtctgaagtggcgagccgtagaacgtgcacggcgcgacgaacttgaagaagcccctgtctagcattgacaggaacccctcgacgttggtttcctctatctccatcttgagcggcccgccgccttccttgtcgaactcaactgtgtagaggagatgaatgttctgaatcagtgacgcagctaagcattgcaatttgcactagactgaaagaacagattaaattggggagcaaattggaaaagaaaatttgatcatgactaatgacagatgaggaacatatcttcctggatcttccttcttgcgggtgcgcatcaaccccttgtgcgcgtaggggacatgagcagggtccatgagattctccaccaacacatcgtacctgcattgcaaaatttgcaatggagctagccatgatcaacagctgcctgacaatggtgcagaaagaaagatttcagagaatggatttgggatttctgtacccataggggagatccctgacgccatagacggtgacgaaggacgggtcgtcgatctgcgggatgtatggcggccgcttcctctgcaggatctccttgtactccggctccgatctcgggtagaaccacaggatgttgttctgcaccacgcatgggtatgatgccacgcacgccttgctgttcttgtgcacctgccattgatgcgaaagctcgattaatcttgattgatttgagatggaggagaggggatgaagaagaagaggaggaggagagtaccgcggggccgagggcgggggcctgggggatgaactggcaggcgccgcggccgtcgaagcaccagccatggtagacgcactggaggcggcccttgtcgtcgacgcggccctcggacagcggcgcgaggcggtgcgggcacgagtcgtcgaacacccgccactcgccgccgccgccgtcggcggcggcggtggtgcggtcgaaccaggcgacgatgcggaggcccagcaccgtcttcccgtgcggcgcgcccgggtcgaggtcgcagacgggcgccaccgggtaccactggtccagccagtcgaaccgctcctccttacccgacgccgacggcgcgtcctccgcccgcggcgtctcggccgccacggccgcaaccgacgtcgacaacagccgcctcgccacggcgcggctccacggcagccgaggcggcgggacgcgggcggcggcggcggcggcggcggcgtcgcggaggtggagcgcggggcgcgcggggcgcgcggcggggaggaggaggagggagagggcatccatggctactcgcgtggtgggggaggggggcgcgagcggcccgcaacgaacttgtggcgcgcgcgcgcgcggttacgttgggtggggcccggcacaaacttatcggcgccgcaggtgattagctggacgctcgccacttggccaaattggagacgggagaggccgatgccgatgcaccggttttacagggtacatttaattatttgccatttttaaaatatgccaattaataatttgctacttttataacatgtggttccttatgtgcctataacatatggattcagagccaaattcttttgaaccactcgtaaaagtggcaaaaagttaattatttcgttttctagtatcacttgtcgagtcgtcgccaacgagccgccagaaactgtccgtgcaacttgtgccgatttttttattgaaagtacaaacagcaaggtagaaccatcactctttggatgataagacagttggttggttttatcggctaaatgccggttaactaaagaagggataaatcccctttatctgtttctaataaaattgaatatgtgatagagttaattttgtgatcggtaaaactaatctctaaaactgtattcgagataaaccctagagcccctccagcgtctataaaatagaagttgaacacaaaggagaagggacgccaaattctctatctaaacttcaaaaccctaaattgcccgaccaactagaaaaggtttgtgaggcgatctcggtgaaattttacattggcgcataagaagaaaagaaacagaagaataagagaaggaagaaactaaaggagaataattaacatcgatggcatattatgtgggtattgaagcataggtgattatgtataagctaaatcattgagatcgtaaatttatattccaacacagacatgctagatttttcattaacgaatcggttcgcgccaattccattaagtagagcaggaaaaaaatgttagaaaaaaatatcgaaaggtatataggaatgaatggaagctgccagtttctaggcacccgaaaggttcaagttttggcatgataaaatactaataagggtgtgttagatccaattttacaccccatcacatcgaacgtttgaacacatgtatgaagtattaaatatatgctaaaaaaataactaattgcacatattgctactactttgcaagatgacttttaaacataattgctccatgatttgacaatatggtgctacattaaacatctgctaatgacggattaattaggcttaagtctcgcggtttagtgatggatactataattagttttttcgttagtgcagaataccctatacgacacctatataatacctgatgtgacacataaaaactttacaccctgatctaaataacccgtaagaatgtactacctccgttttgttttttaatagataacgccgttgactttttttcacatgtttgaccattcatcttattcaaaaaatttacgtaattataatttattttgttatgagttgttttattactcatagtattttaagtatgatttatatcttatacatttgtataaaatttttaaaaaagacgaatggtcaaacatgtgagaaaaagttaacggcgtcgtgtattaaaaaacggagagagtattttgctatagccgtttttacttatggaagagtgacgacatctgagacagatcgaagagcatcgccattgtcacgatggcgacccaatcacaaacatggcagaattgcagagagtctagtaaggcagaagctgaggctgagcttaccaaacacaagcacacgcacacgcacaccacacagtctacctatacctactactacctgtcatcttctccttcttaatcccaactaaatgcgcacataaacgaagaagatttgcactgatacccgcgctgatacaagcaagcatccggcgatggcggcggcggcggcggcaagggggagcgtgtgggagatccagcagcgggacgtggaggccgcggggctggccgacgccgacgcgggcgccttcgtcgcggcgcttcgctccgccgccgccgttgcgacgggtgggcctgacgccgcgtgggaggccgtggcggcgggggtgctgcggccggagcacccgcacgcgctccaccagctcgtctactactccgtctacgccggctgggatcgcgccgcccggggcccgccgccgtactggttcccgtcacagtaagtcacctcgccggagacgaccagactggcaaactgacagtggctggtttcagtgtatgcaaagttcaagcttatgttgatagcgtcctagtactacttaatttctagtgtgatatcatcagtgataagatttccttgtgttaatttccacttgtcatgtcaagtaacctatttgaagtacaatgatcagtgcatgatttctctacgtagtgatttagtgtttgaaatgtgacaggattgacactaaacaaacaaatcttggtagactgatggaagcacatggtcctaggttgttaggatcatcatataaggacccagtttcaagttttcacctcttccacaagttctccgtagagcatcaagaggtcagtcggttgctctaaactagtcagctccagctaagcaaccaaacaagtttgaagtcatttctttacaaccattggagtggctatatgaatgttatttcttgaatggacagtttaagtttccacaggcattttgatcctactcccagtctatcctttgttaggtctactggtcaatggtgctgaaggagatctcaatcaagttccaacaagaaccaaagtcaattctagatacatcagataaatcaaggaaagggggaacatggctccaaggtgctgtgcttaatattgctgaatgttgtctgttaccttggccttcccaaaacaggacagatgacagcacagctattgtttggagggatgagggtcttgacaatcacccagtgaaccgtatgtcactgaaggagcttcacaatcaagtgatgtatgtatatgttatcagactaacagtaagaatcatgctaaagcgtattaagctttgccataacttattctgaatcatcaccattgttttgctgcttttggtgttttcagtacagttgctactgcgcttgataccatgttccaaaagggggatcgaattgcaatagacatgcctatgacatgcaatgcagtcatcatatatttggctattgtccttggtggttttgttgttgtgtcgatagcagacagttttgcacctcaggagattggtacacgcatgagtgtgtcaaaggcgaaagctatttttactcaggtaggaaattagtgaatctttcatgacatagtcattaacactaaagtagggcttcatctaaatttcacgagatttcaggatttcataattagaggagggaagaaggttccactatacaggtacgaacggatgattgatcagttcatttcagtttgtctattctgatagtataatgcacttagcattttgtttttttaaaaaaatgcattttcttcatatatttttctaatttatgacatttgcttagtttgaagttaagtaggagtgtaggacgttatcatgtgaacactgaaaacattctctttcattgattttagaattcagcttagatttttcctgtgaatctaaaaaataggagtacttaagtaccagatagttcatagtacatttcaatcagaaagacaatttgcagaacagataaatatttcataataattccattcttcagccgtgttgtgcaagggacttcatctaaagctgttgtaattcctgcaactggaggctttcttggggtttcactaaggaatggtgatatgtcctggaaagatttcctttcttgtgctgctggaaggtatattatacagaaataaatcttagatggctttggataagtgtattgtctttccattgaagaaaaaaggaacatgcaattgttttttttttctttactaatttcatgatatgagtgacaatatatgttggatttgcaggtcgtccatttatcccacagtttatcaaccttcagacgctctaactaatatactattttcttcagggacaactggtatattaacactatttcattgcttcccctgattttagtatttcttttgtccacccctgatttttgtctgttttatttacttgtgcaggagaaccaaaagctatcccatggtcacaactttctccaataagatgcacatgtgatacatgggcgcatttggatatccagccacaggacatattttgttggcctactaatcttggatgggttatggggcctatactcttgtactcatgctttttaagtggtgcaacgttggctttgtatcatgggtcaccacttggtcgtggtttttgcaagtttgtacaggtacatctgatgtactttgcaccgtcacttgctttggaatgttaaagaagatttatattttatcattgcttcttgtgtgcactgtaaactgtactaattatgtaggatttgagaccctgcttggttgagcttcaggttataatctaaagctgattttgaattttagaatttgattttaggattaatcttaggggtttcctttgttacttttgtcatctagctctcttctcacaattactataacaagacaagtaaaaatcctaactaaattattcttaaaaattaaacctcaaagttccaaattgcttttgatttttcttaaaaattaaaaatctgattattctttgtttattcattctgatttcatatttggttatggcacatctctactgggtagtgagtactaacaacgtgtttcacctcaaaaactgtttttgctctcagatcctgtttctttgagccccctttccccccacaaatcaggaagagttttgccaaatgcttatgtttgaagataaatatgaactgaacttacttaatcatcatgctctgtgaaatattttgcaggatgctggtgtcactatattaggaagtgtacctagcttagtgaagtcatggaaagctgggaattttactgaagggcttcactggaccaaaatcaggtgagtcatccttccactatcagaaggctcacagcttcatcacaatcagaaaggaagttaaaagtagtattataattgcagggtactctccacgacaggagaggcttctgatattgatgatgatctatggctatcttcgcgtgcctcttacaagccgattattgaatgttgtgggggtactgagctggcatcgtcatacattcaaggcagtcttctgcgttcgcaagcttttggagcttttagtgtgcatccatgtccactgggtttgtcatacttgatgaacaaggaactccatatgtaagcatctcccctgaaagttatgtattctggcattatgtttgaagcataaccatttcagttgactatgatagcctgatgatgtaccttgtgctggagaagtgggcctcttcccttatattttggcgctacagatcgacttctcaatgctgacaacaataaggtttattttgatggaatgcccatttacaatggaagggtatggagttatgtacttccttgtctccttttctccaataagattgctatataaacagtccattattctttgatgaaccaaatggatccatttgcatactaagttctagccagaatgacatgaactcatatgttgtattggtactgcagcaacttcgacggcatggagatataatccaaaggacagtaggtggttactatattgtgcagggaagagcagatgacactatgaatcttggaggaattaaggttgaccctcctatttcaaatgttttcaatagcttgttgtcacccttgaattttatgaaactaaataaatactgctcgtcttataaacagacaagttccgtggaaatagagcggatatgtaatagagccgatgaggctctactagaaacagcagcggttagcatcaaacctgctggtgggggaccagaacagctggctatcttggctgtgctaaaagatagatcaccaccatgtgatgcaaatgttctcaagagcaaatttcagagagccatccaaaagaacttaaatcctcttttcaaggtaagagttactacttactcgtttctgatgttaaggtcagatagtgagatgtgcacacgtgtaccgaggtcattggaatcactctttgtcatcttgacaggtgagctatgtcaaaatagttcctgagttcccaagaacagcttcaaacaagctgctaagaagagtactgagggatcagctgagcaaagaactctcgaatcgcagcaagctatgaccgacgtgacatattcaacaaggaccacaacaacaacaacaatagtagactttagtccaaagcaaggtagagatgaagagccatacgaacagtgagggtaattcaaaatcgcttcaaaaatgccctcttgcttgtcaaatggtaatattgaattatgagtgtgtcaaaaaaaaaacagccacttgaataaagagtcatgattcattgggggcgtatagagaacttcaggaaactatttttttccatgttaataaatgttgttgaattgtgagcatgttcaataggcaacggcttgaaaaagtgacatttcccgatgggaatttgtagagaacttcagaatactcatcgctgtactgtattatgttcagctcatgataaagtggtggcatggtgtttggattattttggcacaattcatcccctttgaagctttctgttccttttttaaaatgtttctttgaggggttttatgtgccattgctaggtcaaatggttcatcatatccagacatccagttaatcgtgttcctgaagtgtaaagaatgcatcatcttgaaaattaagtcgtaacaatatttcggtggaaggagccgtgctcacctagtcacgttacagaactgcatccatattctgactttatgcacaccctacatagattaatttctggtgttagacggctaaattgactagcgtgaagcttagttgacagaatgcagagatatggccaatatttcctgcgtgacaaatatgaagaagtcaagctagacatgcagaacaattaattgtattcccattttttttccatatcatgtgtgctgaaacagaactaaaaactcctccaaaaaaaaaagaaccgaaaacacctccaagactccaagtcagccggcacatctatgggatcacaacccccgttcttcctgatcactagaatccaaataccaccagagcaggtggaaattttgttgtacaatgttgaattttttttctttgtttgattggaccattttataattgattttaccaaaattatagttcagtattgtatgctacaggttgtctggaatgagaattaagcaatattacatcagaaaattagacatgctgagtccttccctgcaaaagaaaaaaaaagtgagtcaatttaccgaaatacattaagcctgtccagtaggagaaaatccaactaggtaggcaatgacatcaggttgtataacctttctaatcgccagctaataaccattatcctatgccattatgctcccaaaaggtcattagcataacagcaatgtagtatgtattaaaagcgagagaaagataattctcccagtaacagtcatccatgtccggttttttccacgcagatatgaggaggaaatgagaatatggtactcaagtctgaacagctaattgcccattagcgtgtctttagcatgtaatgatatcgaagtaattttagtgataaatataacaaaattataactaaatgaaagttcaaatttatgcgagctaaaccttcggtgtttaggtttcttgaggtgaaaactatctttccaggctaagtattaaatttaatatgagtgcttatatttatggttaattatttttttaaattgataagtgatatacagtacctcttaacagcgaggccattaatgattaatctcaatgtatgccaagtcaattctacttttaagattcaactatattatacgcgcttcaatttgttttacttttgaaatcaatttcaaagtatgccgagaaacccgggctaggctaggggaggttagcctgcgttcgtaccatgttttcaaaaaaaaaacaaaatttactaaagtcttttaaaaaattgatttttattagctataaacagaagttctttgaaaaataaaaaggagtactccagtatgcacagagcagaagtttggaagcttccaaagtcaaaatcaggtcatagaaaattttagaaacccacggatcacaacatcacgtgaaaaaaaaaagaagaggaaaaactagaagttgccgagagccgcgtggtgttcgtccggtctccggtccagagcgggaggcggccggcaatccgcgacctccacctcctcctcctcctcctctcgtcaccaccaccacggcgaccccgtcctcctcgcccctctaaaagcctctcccttcctttctctctccccttctcgtgggatcttgtattcttgcgtcgtcttgggactcttgtggtggtcaagaacgaggacgagagaggtcggagagcgaggcggcggctgtgccgttgcgcgtgcggtgcgggtgaggtagctagcgagcgagaggggagatggaggcggtggcggttgcgggcggtggcgcggggctgacaaggtggcaggcggcggcgctgtcggcggtggcggggtgggtgtgggcggcctcctccttcgacctcacgcggcggtcgcgcgcgctggtgcagccgtgggtcacccgccgcgtgctcgccgagacgccgtccatcgtcagattccaggtccgttttttctattttttgtttgcatcgcgcgtctcctgatctcctcaagattggagggaaattcactgcatttgctgggattgttatattttttgtagagataatcaggatgttgagacgatttcttgagtgaatagggaatggattttgatagctttgtgttatggaatagtaattgcttcgatttttacatatgtttttgtccttgtagatttctgaattatttttttttggatgttgaattattgcagaaggtgcatcacaagttgctggacagtttcttctctgtgctgtcatgcgttgtctctgtccctttctacaccggattcctccctctcctcttctgggtatgccttcttgtcttacacacataaaaaatgcatgtttcttttcctctgtaattctagctggattagctatgaattgctcttactcttatgtttatgtaattctagctgtattagctgtgaattgctcttgctcttctgtttatgtaattctagtgggattagccgtgaatcattcttgttcttgtgattattgtagagcggacactccaagctggctaggcagatgacgctgctcatggcattctgcgattaccttggcaattctgtgaaggtcactatcgatttatcatacaatagatgagagttgctgatattcgattcgtttagctgttgacactctggaagtctgtggatacaggacgcggtgtcagcccctcggccaagctctcctccggtgagaagagtgacagctactgaagacgagaaggaaaatgccatggaatatggattgccttcatcgcacgctcttaataccgtttgtttgatggggtatgctcgtgtacctattcttttactaagaattgtattctgatgtattattccgtttgtttcgatgtgggaagctctgaagagttcctttgctaatggcccttctggttgatgtagatatctgctgcattatgtcctaacatatggatcacacgacaatgttatggttgtcacgggcttatctctagctttcttgcttgttatgttagttggcattggtgagtctccaaatttctctatgcaacactcttagagttacgtcgttcaaaaaacactcttagagttactagtagatattgatgatgtggtttatttgaaattgataggacggatatatttgggcatgcacagcttgattgatgttattgctggcatctgttttggcgttgtaatcctggcattctggttggctgtccataatcatgtcgatgcttttgttgtctccggtcaaaatggtatatctatacgcctctgagttttgtctgataggtgaaatgtaattttggaaggcttattctcgttatcttttcccttgcagttacaaccttctgggcgagcctttctctgttgctgtgcttcgcatatccaaaaccagaattcccaactcctagctttgaataccacacagcattcaatggggtggcttttggaattgtaagttcttgttgactaatgcctgggtaatccaaaatttttagtagctccaaacttgcttgcatcatagtggattctggtcacatttaatatattatctacaataaagaacaagactttttaggaaaggcctgcccttgaaacaggataaaacagcacactgtttaccgcgtgaatttcattatctagagaagcagctctgacactgtttcttaacacttttcaggtctatggaatccaacaaacctacttccatttccacaatcctgatgtccccctcattttcagcccacaattaccgcttattgtatttgtcgggagggttctcgtggggatcccaaccatcctagttgtgaaattctgcagtaaagctctctcgaaatggcttctaccggtgatgtgcaacaccctgggcattcctattgtatcaacctgctatgttccagcgctgaaggcttccgaaaagtgcaaggtcaagtccgacgcgaagcagggcggttatctccagaaggtgttctccctctttccacagaaggcgtacgatgtggacaccggcataaggttcgttcagtacgccagccttgcatggtcagtggtcgacctggtgccggccatattcactcatttaagtttgtagtgaacactgcaagatgcattctacttggagacttgcaaaatcccaaatgggctattcctactcatgagagagagataatcttatgggactgtaaatccgatgatctccactttatttttatttttgcgtggtgtgtgtagaggtgttttgtccatagtagcaaccaggaagtattaacatgctgtgaaattttgtttcatgatgaagacagcgaccaccacgaactctgaaacttaactgcaaagaaatgccattccttttcttgcattgtattgatgcaggttctttgtatccatttcactttcatgcccatgtcattatctgccaaactaagagtctaagatcaacatcatcttatgaagagactgactgatgtgtccctctttttcttcaaagaaaaaattaaagaaaaatacagaaaccagttaagatcagcaagatgatgaagaaattgcagtgttttgtccccctcccaagtctaaagcctgacggtgaataaacgaccagtttgtatgctgctgttttgtgcgatatcatcgctgtgtgcttgcgttgtgcagaattgacaaagcgagttgctgggccgccggcgaggcgagaacgacgtgcacacttcgcctccggttttctagaactcgaatttcccgcggcgctggcgttggcgagcgcaccaaccgcgctgatggcgacgagagaaacaacctgccacaggaatcgaaggcacagaggctctttttttaagcctacatcaaccatccattgagatatacagtacacctgaacatgcctaaaagaaattcctgaatgtttggggggaaaaggcaaacacaatttgctactaaacgcaaacataagttacataaaaaggtgaaatctcttctctcttttttatggccggtttgcttggtaaattcatgagtgtgtgaccgtgtgaaacatatttgatagtagcggcatcgtagagaccccaagggaagcgatatgtaaaacaagattaaagagtcaatcagcagtacagtttattgcctcggttgaatcgggaacgcaatagaacctatcccacacgacacaaataatccatccactggcaataatccatggccttccttatcagctgataagaggtactattaacttcatccaacggtttcttggggggcaaaaatcatcacatcttcaaggaaagaaaaatcggagctcaagtgttggtcacaaagaattctaatactgtttttcaagcaattatgtacggcaaatcaagatgtactcagaaagacctaccggctcaacagggagccatacaactacattgttcatctctacaaggatcatgaaaaaagaaaaaagaaaattaggtgaaatttgtggggaagaaaggcgaacaaaatgaatacaaagagaatagttttcctttcataatacaaatttgctacttgatgcttcgagtcaccactgcagcccccaagccaagcatcagccaattagagataagtgagaacacgatgaatcctcccagctgtaggtatacacttgaatcatgatgcagcaaagcagctcgcgatagccaagcgccacgggcaaaggtagtaagaataacacacaggagattcgaggggaaaaaaatatctgcaaccagggaacttcacctagctatcaaacatttgctgcagagacagtccaccacttttacatcacaggaaatagtcaggtgttctacgagttacatctggctctccccttcttggggctggctcaaactgcagaatgaaacaacatatagctcataaggtgcaacagaaaataaccgtggagccagatcacaaaggcataagcaaaatgggaacccaacacatagaatgagagttgcaaaagcagaacatgtaccaatcatgcattcatgtttcattagtcaaatacctgtcactggggaccatgaaggggcatgtttcttaatagtcttagtttgtttctataaaccatgaaggggcatgtttcttaatagtcttagtttgtttctataaactaaaagtcaatgaatgttcaaccattacctggatgaatgtatgctccctgcaatcatcaacttccaagattgatgccatgttcccacagcgatagcaataattaggtgcactaaatatggtaacaactttttgctcctgttcagtgtttgcaaaatgttagtgaaccggtatggaaaccaaaaatactgagttcaagtagagataattacatgagcccaattgaatccctccatgaccaactggtgagctctagcaataagtcttaaattattggtatggttgaactgctctgatatatcctgaaatgatagaattgataagtcgatgaacatgaggtgcacagctaaatatagagattctttttcttatataaaatgttacctgcccgaaggtgtatccagcacctcgaggagaaataccccaaccacatcgatcgtctggatcagaccacagaagatcacacatgggcccttcatggggaacttcttggacacgatcgaagttacgtatgttatcaagtgtctcaatggatggcgataatccaccatgcaggcaaaatatttctgactcaacctacagaacaaatgaacagcttctgtcagattcactagataatgtgggaaggatgttggcatatacatatgaaaatgctgaatacacaccaatgctgtcaaggggaagtaatcgaagagatctgtaaaagttttccacacatttgcattcccgtacctgcaagaaatacagaaaaaaaaacggttcttgtaagcttaattcaccaagaaaagggagaataaatttcagtctcaaattaaaaaggtaattgatataatacaagcagcagtgaagtttattgtatgaaacaaattgttgaaaaatagcctaaatacctttttacacatgattcatcactatatttttatcagcacaaaatggccttttagaacattgcagtaggttcatcttatgtcttagtaacaatagttgcaagttgcaaacaactatacacatgaatgatacaaatatccttaatggtcaatggaccaagctgacccatcataaaattatatagaagtaaattagttactaatggatcatattattttaccaccgctgtcatttatcagaacaagactagataaaagcttgcctagaacaaatttactttagttacaacacataacaaaaggcacttacttccttaagcactcgtcatagaatccataaacttgagtgatctgcaaaatgattcaaaaagcatcattcagttcatcagttgtgacttgtgagcatgtacagttgtacacagaaaggataacaaagaatgaagagatgcaacaaaagctttaactttcatataatgacagtaagcaaacatcaagaatctgcattttaaaaaaagtacatacctgtcgactttcgtggtttcctctgagaatagtaattcgctgaggataacgaacctttaaagccaccaaaagctgtttttgtaaaggaatacattaaaatcaagaactattaattttagaagtatttgtaagttaaatgtgcccaccaaaacaaaatgataatcagccatgttgatgcttaaactactcttaccgtgacagtttcaacagaataataaccacgatccacgtaatctcccataaacaagtagtttgtatctgggcactggtaaagtgaagagaaagcataaatatatttgaagtttgatggactcaagatatgcaaaggggacaacgaacaggaaaatacaactgatacctttccaccgattcggaacagttctgcaaggtcatgaaactgcccatgaatatcaccacatattgtaacaggactctttacaggctgcagaagcatggcaaagaaaatgttaaattatcaacaaaagaattcataatttattatatgggaggcacataaccatctcaaggaatcactgtaagttaaaagtatacaaaataaagctgctttaactttcgtttgcacggcagtttcaaaacaaaacaaaacctgtaaggctataccatgcaacacataatacagaacaaaaccaaatataagtacttctgtcaatattatggatttacataaattcagaacaagaaactagaataaaattttccgaggagacatgcatatacatgatctgaagactaaatccttgtgtggttcaacctgggtttcgtctcaagactaccccaacttcctctagattacccgcaacttattttgctattgttgttctattctttaattattatattttgtaaccaagtttgatgtacaatttaatttttttttcgtttctggttgacttacaaaagaatttgatcctagatgaatatttctagtgatctgagcaaagatccatgacaaatttaagagattaatgaagtgtgattgttgcactgccaacatgaaatattcatccttgtcaaagacaaaccatgctcataggttcccattacttcaaagactatagaagctaattcgtcagtcaaatagtaccatcatttcatgcaagtgatccaagaaaacaagctggagtattgcacatttagacaaactaaattttggaagttttccatgcaaggtattgtaacagatgacaccatcacagcatagaagactagtctggtagagatgaccttagtctcaaaagccataagaatataagatattgttggctttttcattgagttttcatgagaaatagatctgatgttttcccttaactattaccacctaaattatactgcgatgaacaaaagcaggcccaaaaatgagatcctggctaatcctagcgaatcaagaaagacatcatagagctgtaaaatatcatacttgaacgttgctctcctccatcaatatctcttttgccttctcgcaaagtgctctgacctgtacgaaaaatactcaagaatgagagcaaatctatggtggctcactaattaaccagaaagaatttaatcgagagaggtgtgaatttggcaaaaggcataaatctatcggtttggaagaccaataacaccctaaacattttcctgccaagactcattttttctttcacaattcaaccagctgccaaaattctgccattgacgacgagcatccagagaacattggcacttcatgcaaaagccaggggcctcagacagaaaataatttcgtcatctcaccgcatctaatcctgtgagatgcaaacctcgtcgctttgcaacccggagagtaaacacacagcgttcgctccaccaaatcacaacaaccgaaaatccgagcaaactttttttcttcaacaaaaaaaaaacgaaatggagccgagcgcaacccgaggcccgatctcccccgaaaggcccgcaaatccgccagatctggccacacccgccacgcccgaaccgaaagaacagacagcaacagcgcgaggtcgagcggcggcggaggaggaggaagaacgaacagccagcagagggagagcaggccgtgtgggtggtgggtacctcgggctcggggaggggcttgcactgcatgaggcgctcgatctggtcgtcgaggccgccatgggggctgctcatcctcctcgccgcggggggggggcgtcgcgcgcgcccaaccctagatctcggcgcggcgtcgggggacgcgctcgtgtgtggaggaggcggaggagaggaggggggcaaaaggtctggtaaggagcaagggacggcggatatataactgagatttggaggcttgtggccatcggaaaaggaggtgaggaagggagggaacggaggagaaggcttctgccaaggtggggccacggttgttttggtgattcaaacctcctccttttttttctttttttttggttgagaaattggtgattcaaacctttgcttaaatttaccatttggtgatttctggttaaatttatctaagtatttgcatgtgtttgcttaaatttaggtgttgaatttgtaattggctacaacaccagccgcctttaggatgagtttagttccaaacgttttcttcaaactttcaacttttccatcacattaaaacttttctacacacacaaacttttaacttttccgtcacatcgttccaatttcaaccaaactttcaattttgacgtgaaacacacccttatatatgacattggaaaaagagccatttacagggtgtgttcggcactaagtttctcaaccaatcttcctcgttttccgcgcgcacacttttcaaactgttaaacggtgtgtgttttgcaaaaagtttctatacaaaagttgcttaaaaactcaaattaatccatttttgaaaaaaaatagctaatacttaattaatcacgcactaattgatcgctccgttttccgtgcgggagggattagttcccatccaaggaatctgaacagagccaatagataatacaacatttaacttctctaaggtgttcacgttgggccgatcgttaagatgtccacgacggatgttagcaattttaatgtgattgttcgtctctttttgcctctgcgagctagtgagatcataaggatgcttgcttgttttcttttttcgtacttcgtgcccaaccatgtgttgcgtgagtggaccaatttttcaggcgcgcgcgagtagtgtgcccacatgtctctcatatgtgggctccagctaggagagacacaccaatcaacgttggcctcacgtatcggttggaacgtgggacatttacttgtttttgttgtcgcgcttgttgcgtgtaggactccgccccagagtctgcctcaaggcagccaagctaaatgaggcgtaagatgacggttcacataccagcgctggtgactaaaggacgcaagcaagtgcaaggggatttagacgatggttttcacctgcagtaaatactagtaacatgagaggatgaaaatgatttttttctaatttattttttttgcttaccaaggtgatatgtaacctaaaatccaaactagaatagagctgaagaataacataacttgttttgaaagttatactacgtggtattttccaattaaaagtaaccatacttgtattgctaacatgcctatctacgtagatgaacacggtagaatacagtgttgatgacaatctggaagaaaataatgatatctgaaagaagaattatggctgcatgaaacaattccacctacaggtcaggctttctgagatgataagacaataaatgcaattagcttttttttcaaaaaaaaaaacctaaaccagttgttgctggttttatattaagcgagtgaagagctgtacatagtaacaagaacggtgaggaacagagaaagaacgaaaacaaaaaagaagcagaaaaagagaacagacagggagatcagaggagctacatagaagcaaggaaggttacaacaaggtgctatttggcgctaatctcgctaagtcttttggcccacatcctatccatgtgttgatttcatccacaattctcgtcaccatatgcaacattgtgagttccttgttcccgaaagctcgccggttccattcacaccaaatctcccagctgagaagcgtatgtatggagtgtgttccttttgttttgctcttgtcgctgtggctcgttcttctttcccaccagtcaagcaagacgtcgttggcatttgcgtggcatgaaagcgtgatcgcaattcaatcttgaagagaccctagccccaacttcctttgtgaatgtgatctcctttaatagatgatgcgctgtctccaagtttctgtagcaaagctgataaaaaatagttgttgggctattgccagagttgcaaccgatcaatcgtccaaatattttttgcagcagcaaccatgcgaggttcttgcatttggatggcgcctaagttttccagatcatactaatggctattgatctggttataccgttgatttgagccaaatatgctgattttgatgaatacttgcaactagttgcattttatgttaatctagtttgcatggtttgattcgaaaatttcgcactgacagactaacaggtgtacattcaaagttgcagaaccactgctacagaagccgagccacaaactgaaatttcacgtctcattttattttaaccctgaaacaaagtcaacaccatgtcatcatggaagcatggacacttcaagcaaagatgactcttgttcattaccaggaattaaattgaagtaattaattactctgttgacgcagcagatgcactaataacaccgatcaaaataaagagagaaacgaacaataacaaggtacaacaaccagatggaactgcaacatgtagcttccctccagtaattcacaagtaacagcggttacttttctgtccaattatcgcaaaaaaaaaatacttttctgtccaatttcttttttcctcgagcagtgctaacaaaaaaactcatccaaatcaatcacttgacaatttcctcttgattgcagttgacgagcactcctccaaatcaccacggttgttagacactttttaggtacgttttagtatgttttttaatacaagttttaagttttttgttcatgcatatgcaaagtgtcctgtaggtgcagggcattggattcagcaccatgaaactgatttgtgctggtggaaccttgccctaacaaaacgatactcaaaattatttaccggtatctccaaatatgcctgcaaggtcatctgtgacgtgaaacatgttctccttttatttttttaaaaaaagaaagatagaaatctagcatctatatccgcaaaggatatagacagccaataaacatattcttctcacagtagtagaacaacaatgtcatatgtgcacgctaacttattgtgtataaggtcaatggctatgtgaaacaacaaatacaaattatgcacgttagagctacaatactccctccattcataaatagatacagtacaaattatgcaattaaaacctttaaatcatcaatatgtaaaatattatatcttatataaaaaaatatattaatagttttttcatgtacatgtattttcaataattttcataaatacatgtttataaaaatcattcatgaaatatattcattagagactaaggccaagttattttattttatttttctaatttctgcgatggactatttactccacgcttattaaaaatatgatttcttgaacttattttactgcaattgtttgcatcacttattctaagttatgtataaagtttttctgttaaaatgttaattaatcgtgtcaatcgagtaaacaaccggtctcaacaatccacgtaaaaaaatgttccaatcaagccttaacgtgtgttttatagtccttctttccaacttctattacttcgttttccgtacgtacgtttcccgaattgctaaacgatacaatttttttagaaaaaaaactaaggaaagttgcttaaaaatcatattaacctattttttatgtatttttagttaatatttaattaatcatactctaatccatagctcttttacttgctagggaaggtttccaaccgaacacaaccttattcatttctctaagtgtaaaaaaagtgacaataaaaaaaaagaaacgtcttaatgtcactgtatggccaatgcaggccacctcacgccacacgctgtatcgcgcccatagtttagcgtggtttaggtggtggcccatagtatacaacgtcatacaaaaagcttccgtacccgggccgcttccggatccggcccataccgggcccatcaacggggccaccgtcatagagcgcgcaagaggcgtgacgtgtcccgtcgcgtcgcgggccaagtcagatatttccggtgcgcggtgcgcccacctcgctcgtataaagccctcccctagttgcccctcttcgaactttcggcatccgctgctgttttctcttccgctttttcctctctctctcgcctcgcctctgcttcctcctcccgttcgtctcccctacctacctagggtttctcgccgcctcgcatcccctcctcctcctcggctggttcgcctcctactctacgcttgctgctgcaggtgagcatccccccgatcccgtctattcgtcttcgcgcgcgcgcttccgctgccgatttgctcgatccagttcgttttgacgggcgattgctcttgtttttgggaggaattccggttgtttttttgtttcgagggcgtttgcttggagttggcggtgtcggcggtgctgcttgcttgttgaatctattggtgaggtgttttgagatttggagctgcttccgctaggttgcatgcgggctatgtagatttggtcgattcgtagggtttccgcggggggattggccgcggattggaaaggaatcacggtttagggtagggttctcccgcttaatcgtgtgggagacgtacctcgtttcgtggcttcgattcacgagtttatatggggtttccccgcttgcatgctgctcttatcgtcgtatctgagatgattgcgttagtttggtgtgattgctgcccgttggtactgtttttgtgttgaatacgttttctaaccgatgagatctactggttaatgttaatgcaagtgtagtcaatttactttgtgctgtaagtagattatgattccctgtccacattactagttggagattggttttggtgctgtttactgagtaatttgcttagcatagttgtagctaccagagctcttagcaaaaatctgccaatgctacgaaatatgataattcccactcggctctttgcctctgttagctttagtgcttctttattgtggattttaagcttcattttaatttctggatgatgtttatagagacataatttggattgtttcatatatgttttcatacaatctccagtaatttgactgcagttacatgttgtgttagccttatttgtttgccacttaccaaaggcttaccaaaggattgacaagaaaaaaaattgatagttgttcatttagttgatattctgtattgttgccgctgaagcacctttcttttttgttcccagatgtcacattatgtttgtattgacttgctttatgtatctgttatctccaggtacaagcgataagcagtagcttcttcatcaaaggttttgtgcaaaattatgcgatcttcatgggctgattcagttgcgaacgccgaggaatcggcgcccgcgactggtgctgctcccacccctgttgctaatcaccagaactcacgccccactcgcagcgcatacgtgcctcctcacctccgtggccaggcaccaaccacaactgcagctccagctccagctccaggaccagctgctgtccagccctcagcttctgtacagccttctggttacgcagctattgttggtggctctcgctgggctggccctgccagtggtgatggtactggcgctgtaggtggcccacgccagagcgttggtggtcgtggtgggggtgggggtgggggtgggggttggaactcccgccctgggtgggaccggagagaccgtgaacctaacccttttgccaatagcgaggcagaggaagccacagaggttgattttgatacggcaaacactggcatcaactttgatgcctatgaggacattcctgtggaaacaagtggccatgatgtgccaccgccagtcaatactttcgcagagattgatttgggtgatgcgctgaatgagaacatacggaggtgcaaatatgtgaaacctacgccagtgcagcggtatgccattccaatctccattgcagggcgggatctcatggcttgtgctcagacagggtctggaaagacagccgccttttgtttccctatcattagtgggattatgagctctaggccaccacagaggccaaggggatcgaggactgcataccctcttgcattgattttatcccccactcgcgaattatcagtccaagtacgttttccactccttttttggtttggggtggggcatggggctgtccttattgttgcattgtttcttactatatacttttctgtttcagattcatgaagaagcaaggaaattcgcataccagactggtgttagggtggttgttgcgtatggtggagcaccaatacatcaacaggtttttctcgcagccttatttatttccgcataatgatggatcaatcaaccttggagctttgctgtttggtctgctgatttcctttgtaccttaaaagagatcattatattgtgttgtgcatatgagccccccttccattcatgtgcactctagccccaaattgtaaccttgctcaataatgtataacgaaagctcgcaggtctctaggcattctagaaaggttatgatagccatcctattttgtttgtgggtgctataaatctaacaagtgatctttgctgctggctgcatacatgctgtaatgtggaagagacattattaattatatgaatgtctttccaaatcattggacttgtgaccataccgtgctaaaaattgactggagctctcataacatagatatgcgagctatcttaactatgtatatggtgatagatgattgaagtatgtaggcccagaaaaatagtcatgcatctgtttaggcaatcatatcatgaccaaatattattagctttggtaagctagcctagaaagtaaacagccatcctttgcatagtgacgtgcatagctattgaacacacgctttatctgttattgcagttgagggaattggaaaggggcgttgaaatccttgtggcaactcctggtcggttgatggatctgctggagagggctagagtatcactgcaaatggtgaagtacttagctcttgatgaagctgatcgaatgcttgacatggggttcgagccgcaaattcgtaaaattgttgagcagatggacatgccccctcgcggtgtgaggcagacaatgttgtttagtgctacttttccaaaagaaatacaggtatgttttctactttaaacttcctgctttgataatatccatcagcatatgatgtatttaacgattttattggcagtcctgcaatttagtcaatttatacctgtccaatagttggttgtgtgtttttatcaaacgtgtattccaaagtaaaaaaatcagatctattactatagtggtctatctacctacatttaagaaagatcacatgcaacatgtttcaggggtattgttttccaaatattgtgtggtagaatttgatcggaaaaattgtaggcacaaatgcctacagtaaaatactgcgataatctatatgcagtcatctggttagataatcttatatttttcttgatgcaaatctcctttgcccccttgcagcgcatggcttcagatttccttgcggactacatcttccttgctgtaggaagagttggttcaagtactgacttgattgctcaaagggtagagtttgtccttgaagcggataaaagaagttacctcatggatctcctccatgcccaaaaagcgaatggtactcatgggaaggtattgatgcatcaatagttcttgatgtaatttactttatgatatcatgaacatttattcactagactaatgaaagctactcttaaggaagataggttcagctcaaactgtgatcaattatgaatctttatgaataggagtattgttccaccagctcatgttttcatcttgtttgcagcaagcgcttactctggtctttgtggagacaaagaggggagctgatgctttggagaactggctttacacaaacgggttccctgcaacaagtattcatggcgaccgaacacaacaggtacgccaatctgtggatgaccttgcactatatgacatgggcatttcaattattttctgatttatctgtgcatatcataattggattttagggaaataaaaagaacttcaatgctccaacaaggcaaaaacaaatgcatgttactaccatacttgatatgtataattttacaaatggaagtgatagctcatcactcgtctaaaacaatgcagtgataaagctatcttatatagagaaaattggaaccatgccattataatttgtagaaaaaagttataacatattcaacctaaaataaatttattatgaaaacatattcaattattgatttaattgcttccagtttaatcaagtttgtagaaaaaagttataacatattcaacataaatggttggcattctttatgttttgtttcaataattcagactgagcagcatgatgcttgtttctgatgtcacataggcacatgtatggcaccttgttgatgccttaggtctgctgaaatgtaacatctttgttatctctgtatgcttggtattcccaggaaagagagtacgcgcttagatcattcaagagtggagcaacacccatccttgttgcgactgatgtagctgcccgtggacttgacatacctcatgttgcccatgtcatcaattttgacctcccaaatgacatagatgactatgttcatcgtatcggacgaacaggacgagcagggaagtctggcttggcaactgcatttttcaacgagggcaatctatccctggcgaggccgttatgtgagctaatgcaggaagcaaaccaggaggttcctcaatggcttgaacgatactcggcccgttcttcgttcggaggtggtggtggcagaaaccgccgatcaggcggtgcccgttttggtggccgtgacttccgccgcgacaataggggtggaggcggcggcggttatggtggtggcggtggtggctatggaggcggcggttatggagggggcggtggatatggcggtggctatggtggtggtcaaggctcaactagttcgtgggactgatactgattcccggctgtcgcgagcaacgatcatattctattgatttccctgaaaacatctgatgtgttgggatttgtaatcagcctggttggcatggtgctggaaaatgcgcccgtttaccttcaatttatggatggttgttactgcactggctttctcgtttactggcaatagtcttggttggctgattcacctgtccttttcagttgattgtttcgcgtagtttactagtttcggacgaggcattactggccagatgttttttttcttttgtttattaatgttctttcatttttgaccggaatacttctatactagttttggcacatttgcattgttacgcagaagtgattaacattcgacggtgttacatatggtatggataaacatacatgtttttcatcaggcaggtgagagccaagataaatggatactgcatataatgaataaacaaaagaatgtcgccgggaaaataaacactcgcatgatcttaaattacatcaatataacacaagctaacaaaaccacagctatcttcattatcgaacaaattcttttttgccccattctacccaaaattttgcaagaaacaacccgcattcttataaaccatgaaaaggtttagggtgaacagataggtgaagagatccaacttcatagaagtacagtctattcttgcagtcagtcagtacttataattgctgcatgtgctttggagttggcgctgataataaatctggatatcaaattcacttcatgatcaaatgcagcaggcccttccctgtttcaaattttaaaacgaaatagaacaggtaaaattgttgaaaccatttgacatacctgatgcgcatagattgtctagttgagggcaatggaccacctaggacgaatcacttggcatatatcatgcccaaaacaatagccaccaacagaagtacaaccattatctgagcaagtcacagaaacagtttgagaaagataaatagaaacagaatcactaaaaggatttaaggtttatatattattctcaccagcatggagttgtactttgacttctccaaatcgtatcccctgcataattaagatgatcggtagggatgagaaatgccaacagaaataaatggaacactaaatcagaatcaaccaacaaaccttctctttagtgagcaagatgacttgcaggttctctttatcgcatcaacacgtttccgcgttagggaagcatttggatcattattatcaatctggacatgtgggtaaaacatcatacactcttgagcaggacaactaaggtagcctttgaaggccagaaataacagtgcacatcctatatttgctgtttagaacattctgctgaagactaaaataatttcatgatccttaaatcaacacaacatttaatgcaaaagtggctcaaagaacaagttcaaaagaaatgtttacatattaacaaaaaataattatactgagtgaagatttttgtgcaatacaattgatggatagcaatctattgtaaaaaatgaaatatttgagtgtcttattatctatatggaagaaatgagcgacagccaccctacattcatggtagcaaagatcatggtccttaccttcgattctatcagcgaagagaactcatagaaagcagtatagacatctgacattgtgtttgtctcatcaattactcgtgcagtgagccctgagagaacatgttaatttcctgaggtgagagaacataaaggtaactagagactggagcagatgtacttagtttataatagataaaggtgacaaaacaaaataaagttgcttaaggaaattattactactatgcaaattcagtgataaatatatataaattatagttgcaccttctgctaactaaattatagctgttctactgagatatggagccatgtgcccaaaaaacaaagcatacaataattctaaagatactcatctagtcatcttactcaacaaatcaccattctttgtctaaaccaaaagggacaaagaaatgccagcaatgaagtggtgaaatcttatgatacactaatcaacaaaactgacacaagttacaatgatgccaacttgtgacaatgaacacaggagcactccattgtgtaaccaataggattattgttgcacattgatcaatttctgacaactgagtaaataaatacaattactcttaaattaaccatacaaaagaagagaaccggatagcctatccatattgaattccattaagcaaactctgacaaggtggtcatggagataaaataactattctcctcaaagtaaagagaggttactgcaatttgaatttacttagtatgtcttatgtaatcttaccacgcctcatcttaacaactcctctaaagacattcacattattgtagcaaatagcacatgtcccaattgccattatctgaaaagatggaatgatgtattagtatcctaaagtttgttccaaaataatacataccaaacatattacaagaatagaagtgtataatactcaaacacaaaatgttaggtcaattaacagcttcaaccaacgaggaatgctacccaactgccaacaaatatcaactatcattggcccaagatttagcatgtcaacagtgatcaaacatgaactaataaacaaaccaattcaaatagctggctcctctttaccacagatatggtacaaagatttgctatagcagtaaattactgtgagtctgtgacgccccagaataattaggaaaaaaatagagatgaaggggaaaagatagagaagaagagcaagtaagcaggcagcaatgagcaagctagttagcgtaggcgcaagtgagcagcaagcagaacagccatctggccttgggccacatgtgagcacagcagcaatagcgctagctagtaaacacgacagcaaatgcaggagcaggagcaggagcagcagcagcagcaagcaagcctgtagctagttttttagattgcctcattattgccgcgacaacagcctagttcttcacattcaccgagcaatgcatgcagtcattgaattacagaaaaataaaggtatgcatttctgtgtattagctaaagcgttgtgggcagagggctccgctacttcattcaggggggctagcctcatgacttcactggacgaggggtactacttggaatatagataggccccattctgattcgtgcgtaattaatgtgatgattccatgaatctcagaaaaggtaggggtcaaggacctagcctaactatttctaatggtacaaccctacttcgagaaagcctgtcttactgcatctcgatctatatgaaagagcactggtattttctttcggtttcatcgatagcagaagagtacgctagctagcatagcctgaaaacgcttgctcagtaccacctcggctagctggctccatgtgcaccagcttataagtagtagtctggtagaataaattcccggttaaccgtcactcagatgtgtggttcaagtagatgagttgggcttagatccatacctggaccctaggcattacaatcagcattacatacaggtattttaaaaaaaagagtaaaatttcctagacgtgtacactagcaataggtgtacactagcaatagcttaactaaacttcatggccaatataaaagttatcattatatactgcaagcaagcacaagagaatatcataaactgttaatatttgacacagactggcacaatttgcattggttcaaaaatttggtactataaaagattaacatatacctgaggtattgcacaaaaacggaaaatggcatgatccttcaatgctgacatgtattggaggcagtcttcagcatgagacagagcgttagtcaccatatcattcaaacactgaactgccttttctgaattttcctcgtatttcaaatcctgattttataaaaaaatgtgtattattacacacagaaaatagataaaactgtagtggactttccagcataataaatgaatttatattatttggttattgacagttggatttaacacttcaaatggcatctcttgtcaattgtggtgacaatttaatcatttcgaataaatttaaagctacttcctccgtcccgaatacttgtcccaaaatagttgtcactttaaaatactacttgtcatatcaaccacttccaattcaaatttctccccattatacccccaaccatcattccacatccaactatgcattattaattaaggggtattatagtctttgtcttcaaaccttagtacatgccaaataacgtagaacgacaagtattttgggacggaggtag

SEQ ID NO: 69568 - DNA, 1783 bp, Oryza sativa
tcctgtgagactacaaatggccacaaggtagataacatctttcatatggaggaaaccaaaagtacaaccacttactgataggacagccaaaaactggacatggaactgaaaagaaggcataaaagcatgtcaaggttgcatgaagcatatgaccatctgttatagcctttggtcatcacttgaataccagtaaaaacatttgttcttttaagcacgatatatagtggccactggctattcactagataccttaggacttaggaatagcgtggaaaagtatatggacacaagcacacaggcttttgtcattctctttggtcaaaattcacagtaacactcctaccaagcatgaagttaccgaaacacaccatggactgtaccctattttttgagccagaaaagaatatgcacggatagtaccatatacagggcagacatttctaataagtgatgagacataggccttaccatctactgctgatatggaaaccagaaaaaaaaaaagagtacaaggtcatcgcctcacactaaaattaaatactggtttttgaataaaatgaccttgtgatctccttatgttaagaacattgcaccaaaacatttatttcaaaattatgtttgcttagatgttttgatggctatattaacaacatacctccttgcagataaattttgccattcctgctcccattagcctagtgatttcttcaattgcctcttgataactaagaaagaaaagagtatatcagaatattgagtgatgcaagtatccggggatatgggcaaccaaagtaaaatgcaattttacattcagaaacggctgaacacatgctctccgttattccaacaaaatttggtctgctcctcgtcgaaataatataaatatgaccaaatataatcgagtgtgaagaatacttaacattaacaggattgaagaagttctaacaaaaacaatcaaaagaacacggttcatagggttcacgaatataactgccgttcaagtttgtgtagtcccctgtttttctgtaggatgcttgtttgctaattcatagcaattatcatcgtacaaatcatcttactgtgtaaatatcatgatcagctttttatttcaccatttgagtctgaccatgcaggatggtttctcagctagctactactaccaagtgaacgccacattatgtagaaaagtcttgaagtagtttcatggatatgaatatctggactgacgcgtccaaagaatttgagactacgccaatatacaatttgagaaatggcatgcgtccaaagaatttgagaaaacgccaatatatgagaagcctcaaagatgtcaagtcgcgaagtactaggaaccaagaaaagtcagacaaggaaaacattcagaagactcggaactgaatttacccttgaccaagctccaagaaagccgtggagacaaggcgaaacttatccatcagtaatttgtagtcttttgttccacctgcaaggtcacatcaaaccaatcaaactccgattaacaaaacacaaaaaagccgccatcctgctcagcctgagaacagcatatttagtggagcgataccgtacatgaataatgccagtcgcggttgtagatatgccgatggaattccttaaggatcggcaccttcaccgcggcaggaatgctagtgtcgtcctctgcacgcacccatgaaaaaaaaaaacatagtatgtaagtcgataaaggaaaacacaaaaaccatgggtaattcaataattcaaaaggcgccacaaaccactttgtttgaaa

SEQ ID NO: 69569 - DNA, 38738 bp, Oryza sativa
  unsure (1)..(38738): unsure at all n locations
aaccagctggactccacgtggagcggagatgggggtgtgggcggtggggccacggccgacagtcgcgtcagggtttcgtcgttttgtttccagagggatcgggtgtctttcagtgtttgggttttcactttttcttcttacagaaaaagaaaatgtttgtacactatttatgccgttggttttataaagtcaaagaatatcacattgctggtctatcacggtatagggcttgcacgcttgtagtgctggctgctgggcgtggctgcattttagcgatagtactaacaagtctagcataaatttttatgttgtacaatctggctcatcctcaacatatttacaaacgaaaaaataatactccctccgttttagattgtaaaactttctagtattgctcatatttatttagaagttaatgattatatatatatatatgagaaaagtgtacaggcggtccttaaacttgtaagtgtatgtcatctaggtccctaaactatcaaaatgcatatccaagtcccagaacttgttatagtgtgttatctaggtcccaaatcgacacaaccccttcaggatcctacgtggcattgatgtagcatgctacacggacatgacatggtattattttgactgataaatgggacccatttaagttttttcctttttctttttcttctcttttttcccctttcttctcctttctttgtgacccatgcagaaaaaaaaggaaaaaaagaagtatgagaagaaaccgaaaaagaaaagaagaagaagaaaaaaaaaggacacgtcacgtccatgtggcattgccacgtcagcgccacgtaggattctagaggggatgtgtcaatttgtcactttgacaagttctggatctggatatgtattttgagagtttagggacctatatgacacaaccctacaagtttaaggaccgccaatacactttactatatatatatatatatatatatatatatatatatatatatatatatatatatatatatatatatataaagtcttacattgtgaaacagaggaagtatgtgaataaaacttttctatacatgtgaaaaataaactttgattaaaaaaatcccaaatttacctttaattttaaggttgaaaatttattttttttataagcataagtataaacaaaaagataagacctttcgaagctaaggttaatattttaattagaggatgtagttactataatagtagtggtccagcaaattaagtatacatataataaattgagtgtgatccaactataaactatcgaataaattgccatgaccaaactcttgtttttagtcatgtagccttaaattcgacccgcatcatgcagatccagctgactggaacctaaggccatgtacaacgcatgaccctagcctgtggtctcgcaggtccacgtcggagctgagccgagctgtcatgagtttgggtggtctcgcaggctgtcagtgagcttgtagagaaactggtgcaagcgtcgcgcttgggctcgggagctgcaaagccacaggccgaagcttcgtgttggaggagtcggagccccgcacgttgcctcatccggtccccccgtgccgtggtcgtcgtcgcctcacaagatctgccgcagccgccgtggttgtcgtcgctgctccccgccgccgccagatccgccgtcgccgcttcgccgtcttcgctgctccctgccgacggatccgccaccgccgccgccgcttccctgccgtcggttccggcgagcccgcgcctggatccggcaagctcgccgtcgccaagcttgtgtccacgccatcgtgggtggaggaggacggcaacgtcgaggaatcaccgccgcgttgtggccaccgccgctagatccggtgagcccacgcccggatccggcgagcgcgccgtcgtggggggaggaagacggtggcgtcaagccagccgccctcaccgctgctccccgccgctgccaccgctgctccccgctgccgccgccaccgctgctcctcgctgccgctagatccgccgccgccaaagctcgagcgacgccgatctgccgccggagtggtgggtggcgaggggaggaggggagaggaaagagcgtcggtggagaagaagtcgaagagagagaggagagtggaataaaaaagagagggggatgggaagaggctgacagtgggtcccaagttgtttaggggtatacatatacttcttttggttactatagggttcaaaatataaagtttcaataggtttgataatacaagggctgacatataaatagataggggctgacatgcaaaaacgttttggagtggctttcactgtgggtagtgtgacctttgtgtggttctatcctacgtggcgtcttgagccatagttacttgtggctaccattgtacatgccctaagggaagagatccttcgagtgaaacagctaaagtgattgacagttggccgcgaaaacaacaagggagaaaatggtttaaactaaaaattagaaatagttcgcatggcttaaatgcgtgggccgaggccttatctcatctcgaagccatcagcccactccgtcgtcttcacatgggcctccgttttgctttgtgctcacgtcgtcttcaaacgggctgggcgggccgcttgtatcttgagttgctgaacaaaagagaatagggacatttacaattttaccactatttttttcacttttacaagtatgtcactcgaataacagttctggtgatattttttaatacttcggtggtagccttacaataattattcaaacttctaatagcgtcccataaatagagattacacttatactctctctgtcaaaaaaagaatccaatcttcgagatgaatctggacacaatatatgctcatatttattcttagaattggatttttatgagatagagaggagtatatttgagtggtgagaaattgtaatagcagcccataaactgacaaacagagataggggactgctaatgcgcgggtgatcgctgggaacgatcacccgcacccgctccccctatacgtacgtccctcttctccccctctcttccctactacagtaaaccacaattttttttaaaaaaaaataaaagttagaaaaatttatgtaaagaaatactatatataaaaaatttgaattcaaattcaaatttgaatcgggtatataaacttttgacttacaaactttgggtctataaactttaggtgtataaactttagatgcatagaaatactatatatagaaaatatttgaattcaaattcaaatttgaatcggatataattcaaattcaaatttgaaactggtatataaacttttgacttataaactttaggtctataaactttaggtgtataaactttagagtatagaaatactatatataaaaaaatatttgaattcaaatttaaatttgaatcggatatataaacttttgacttataaacttttggtctctaaactttatatatgtaaacttgaggtatataaactttaggtgtataaatttactaaaataggaaagtaatgcggtaccaaaaaaaggaaaccaggtggagggagggaggggggaggtgatcgccaccccatccccagggcgatcgatcgcccaacagcatttccgacagagataacatttccatctatgattgacgagagtatgaataatcattgtttctgcgcagtgacttgtaagttagactgcttcctccagttttaactacctgtcaatgttgatcaatataatttcagcttggatcatcaacaaattttgattggtcagatcataacgtgataagtatttcaacccaaaaattggtagtcctacatgttattgagatatcgatggtatatctcaaactttgcaaaattataatagcatggttccaatttaaaaaaaaaaaagctacagtacacttatttgccgtgagactacatcacgagacaaatttatagctacaattatcattgtactcaaaagttgttgcgacttgatcacatcccagatgatgtttacttgggagccaacaaggatttctagaattttaaaatccgcgcacgaggagcgcgagctgcaacgttgcaccttagaatgacgcgcgacaaagctgaaagctccttaaaattatggacgcccacgacacacacggacacgcgttgctacctcgccattggagaaccagtttgctctagctgctccggccgcgacgccgccgttgcaccggccggcacgatgggagacggcggcggcggcgggctcgacgtggtggtgttcccgtggctggcgttcgggcacatgatcccctacctcgagctgtccaagaggctggcggcgaggggccacgacgtcacgttcgtctccacgccgcggaacgtgtccaggctcccgccggtgccggcgggcttgtctgcgcgtctccggttcgtgtcgctgccgatgccgccggtggacgggctgccggagggagccgagtcgacggccgacgtgccgccggggaacgacgagctcatcaagaaggcgtgcgacggcctcgccgccccgttcgccgcgttcatggcggatctcgtcgccgccggtgggaggaagccggattggatcataatcgacttcgcctaccactggctcccgcccatcgccgccgagcacaatgtacgcacgcgcgctcgcacgtttcagtatttttgtctgagtatttgatcgaacacctggcgcgcgcgcgcatggcggtcatgcaggtgccgtgcgccgtgttcctgatcgtgcaggccgcggcgatcgcgtttctggggccgaggtgggcgaacgccgcgcacccgcgcgcgccgctggacttcaccgcgccgccgaggtggttccctccaccttccgccatggcgtaccgccgcaacgaggcgaggtgggtcgtcggcgccttccggcccaacgcctccggcgtgtccgacattgagcgcatgtggcgcaccatcgagagctgccgcttcaccatctaccggagctgcgacgaggtcgagcctggggtgctagccctcctcatcgacctcttccgtcggcccgccgtcccagccgggatccttctgacgccgccgcccgacctcgccgccgccgacgacgacgacgtcgacggcggaagctcagctgaccgtgccgagacgctccggtggctcgacgagcagccgaccaagtcggtcatctacgtggcgctggggagcgaggcgccggtgacggcaaagaacctgcaggtaggggtgcaagtaggcttgtcaacgaacccgtttaaagacaaaattagtgtatagcctatgggtttgacttgcggatgatctattaattttatatatcaacccacttatatatcttagatgtgacaagataagccactacatgaaaacctataaattattatttatttgacctataattgaattcgctggtcaacctgcttgcattgctacctgcaggagctcgcactggggctggagctcgctggcgtgcgcttcctgtgggcgctccggaaaccggcggcgggaacgctgagccacgcctccgccgccgacgccgacgagctcctccccgacgggttcgaggagcggacgcgcgggcgcggcgtggtgtggacggggtgggtgccgcaggtggaggtgctcgcgcacgccgcggtgggcgcgttcctgacgcactgcggctggggctccaccatcgagagcctcgtgttcggccacccgctggtgatgctgccgttcgtcgtcgaccagggcctcgtcgcgcgggcgatggcggagaggggcgtcggcgtggaggtcgccagggaggacgacgacgagggctcgttcggccggcacgacgtcgccgcggcggtgcggcgcgtcatggtggaggatgaacgcaaggtgttcggcgaaaacgccaggaaaatgaaggaagcggttggggatcagcgacggcaggagcagtacttcgacgagctggtggagcgcctccacaccggaggaggggagatcaatgacgaaaaatactgttaaaatgcgtgttaattctgtggtgaataataagagcctgataacattgtcaagcctaatatgagatgtttatattacactgtggacgtacacgcatgtacaccatacattggcaataataagattgtcaaagcagcaaggtttgcatgggatgttttttttttttgaattgcatggaagatgcacaagtgcacacactatatatgcaacatcacaccaaaatatcaccaaagatgtttcctaacacacactcaaagagacataaaccgctaaaatcttgttgacatcatactagcgtgtacgtaatatctgtggttaccaggatttaaatcctggtgattaaagtcaaccacccaccatttcaccattatattaatggtgtttcccctagcatgagatattttccctcttattttctcttttgtgcagatgttgccacatttaattttataaaagtaatcaaattttaaatatctgacttaacaaatgtaaaacgccttatgatataaaataaatgaagtataaagaattattttattgtatttgaaaaaaaaatcctcccaagatatgagggcctgctctgctggcccatggtatgtgaaaatggaatggagaagcattctatttcactaccgtgttttatgtagtgtcatttcttgttttcaaaaaatatggattgggaaggtgtaacagagatgcatccatggtttgaaggtgccataaaatgttggagattaaaagccaaacagaggcagaataggcaatgcatacacccttcgttctaaaaataacttctgatgataaatctagataaagtgtccctataagtagatcttttttttttacggagaagacttatattaaacgacccatgagcaaagatctgattattagacattgaatcggttatgaagtgtaatgttcaagaaatgacaaactgcagatgcgtcatcgtagcacatagtacctctgtcgcaaaaatacaagcgtaagtgattcatcataccgtagaacaaaaaagagttcagcgcaacaaagaaaaaagatacttcggcatacaaatctgaaagaacaaatcctttttagagctaaccattttgatacattggcatgataataatacaccgagacaaactcacaaacacataccccgcagaaaatcagctcaaccatgcagcccccacccaaacgtgctgtccaggcaccaaaatcttcctactgaaccaaacttataaataagataaaaaagaggtctacttcggagaaacctcagaacacggtaaacatggaaaatatagcacggtagcaaactaatcttcgtccattccaggctgagcatctctccttggccctcctgctggctttgccatgatgatctgcataattcatgtgcacaagcattagcatatgggaatgatgaaacgatttcacttcatttttaacacagccaacagtacaagattgctcttacctggtcaacccgcagtacagtacatgcagcatccgcagagtattttagagcgaataacctgatgagagaaaagaacacacatgatatgaggttggccaacttgcttaagtctcgccagtaaacatgcaaataataaaaaaaatgaatacatgggtatcacgaaaagtaaaaaacagcgtgcttcccatacagtacgtgcacctattatgccatactggaaggttatggcatatgacttactttgtaacataaaggtcccatattttcatgattgagacatccttgcaaccaccttcttccaagtcaataccaactttcgtattcccaccagcatgttcagcataaagggaagatattatctccatagcactaagcccagcattttcagccagggttcttggaaccatttcaaaactttcagcaaattttgcaatggcatactggtccaacctgcataattgttaactatcaatataggaagcaaaaagcaacaatgtatatactaaggacaatgaacatcataaaccaaggtacataaacagatgctcatgaatcaaatgtatcaggcatactgacgtataaaactctagaaaactacaagcgaattcattttttttaaaaaaaatccagatgggttaggcagtatggacacctcaatatataagtaagctgcacctggacttcagatagtttaattcaaatattacaggagaacattagcaatagggcttattatatttattgacagtcgactggaaacaacaaaagtttgtcagaccaaaagtagtaaaaaatggaacatatttttatcatcatgttccacacatgaaaattttgtctaacaaatatacttaccctgtttccttcagagaaaattccttcaatctccttgccaattctatttctgttgcagcagctccaggaataatccgactatccctgcacattgactgtataaacaccaacagtcaggtaacctgttagctaattaaataagagtagcatgtatgttccaaaacaatgacaggaagttgatttacagtcataccttgtaagtattcacaccatcatcaacagctctttcaagatcatccaatatactatcggtgctgcctcttaagacaaccgtagccactgagtttccaccttcttcattcttgacaacagttacctataaagaattaaacgtggtaagaagaatgaagtcatgtctattggaaaggaacagaggcatgaaacatactcgggcaccaccgatctcttccaccgaaacagagtctgcatatcctaattcatccgcatttggtcggctgagtttcaactgtttttgaaagagcacatgcatcagcatatacatactactgtgcaattgaacaaaagcttgagatcagaacttacaagtgcaatggaccctgtagtacggcaaaatcttctcagttcaaattttgaactgattctaagaaccattagcctgcaaataaatagaatggtaagtactactgtaaaacagaacctaatcataatcattacagtgacccaactttgagacacctttcaacatcaacattagaacttccatctgaggatttcagttgagtagagtatttataatattttcagttttgagatgtaaataagaagttgcaaaaaagaagaagagagaattatataacatatcaagcccattcacataagatgcaaagaactgacttgtaacgctcacagaaatgcagtgccatgtcgccaactgctgctccactgacaataacctttgcacccgagtcagcaacagctttgataagctcctccaccttagcttcctcagtcttagcatagttttctagctgcacaacagtacaagtatgagtgcctactctgcagaagatatttgtggaagacagtgcttttgataaactacagaagcaagaaccctgtgctggtcagaacatactaggatattgagttataattgcaactagggctcattggtattttacaacctacaaaatagattataagtggaaactagcttaatgcccatgctttgctacggataaaataaaataaaatatttttttcatgaaatgtgttaacacctttctgctattgggaatattcacttatatgtggctatccatttagatttgatgttttatcaatattaagaagttcaaggggtaatttgtatttttttaaaggcgtaaaggcacacacacggaaagaagttcaaaaaataaacaaaagaaagcaaaataataattagaagataacactgtaatggattagtctataaatgagaatgggtaatataatagaacacataacttgaaagttgaaactcgaactatactaactgcagtaaaacgttcgtgataattaggccaaaaaacgatgtttctttattaagaacatacctgctcagcagaatgtatcaaaacagttcccttggtttcagttgcagaagtatcaacaccgccagcaaatactgcaatctgattgatttagaaattagagcagatattgaccggcattgtatagagaagatcatgtaacttggattggctaagactacaatgtgcatacagtgcatgaatacatgaataggtctacaaggttgcagtttattgtaatgtaggtgtacagcttctaattgaccatgtaccatatgtaagattattgagcacatcaacaaaaaaactgtaaaaatgccacaggtattctaaagaaggtttgctactactatgccatatacaaggaaagaagaatgttatcatgcaattcctaattaagccatatgatcataactaggtggagaccaattgaagactgactaccaaattttagaaccctgctaccttcaaagcttgttagcaagatatattccattaaatgtaaccaccaagcaagccttgagaaaatcctttacatcatcagtgtgaaatgacaaagaaaaataagtatcatatctcaaatcaaaatttcaaaaagatgaattatttagttattactatcgattttatggtgggaagctacaaagaatagaataacaaatatttgatcccaagtgatgatatgcttcatccatgaaagggatgagaaaggaaaatatatgttaacaccacctaatgtatgatagtatacagtgtggaaacagccctcactataaaagcatgacagtatcatcaatcgaaaatagataatgtatcaacagactgccaaaagacacaccaccaattaagtgtaacatttagttgtcacctttgccttctccacccttttgatgctcccaacagcgtcatttttcagaaccatcccccggactacagaagagttgtgcaaaccacctccaagtagtttcgcaactctaacattgtcaacgttgaagttagcaggatttttcgggcagacttgcatacaggcctgaaaatccatggtaaaaaaccagctattagttgttaagaaatgagctccctctcacataagatggtaagaattgtcttacatcagccacaagagggcacaatatatcctcctgaccgaattgcttgctcgcaactgcagatctcatcagcaacacaacctcctccttgttcctcacatccatgttctctgaacctttctccacaagatcttccaagatctcaacagtctgcgcattgcagatgcaaatgcatgaataactagcctgccatcaggcaacaggtttttttaatcaatataaggccagctcaatcgggagggtaagtaaccttattaatggccttggtgtagccaatgatgatctcacttggatgcaaccccatcctgataagctcctcggccttctcaagcagttcaccagcaaaagatatggtgaggttagctccatcaccgatttcctcctgctgagccctgccagctagtaccaggatcttagcagcagggtgctggacctcgagctcattcacaattgttgcagcatcgttcgtgacaaagagcttgtcgagatggttaatgaccatcttattcattcctaccaaaacaaaacagcgatgctgttaagaaactagcttctgatactaacatgaatctgtcagatattatacatcacagaaaaatgtagcgcaggagcatgtttactgctggcctctaacaataaatcgctgaaaaattaactgaactcaacctaaaaccgcaagacaggcaccacaattttttagtgtccaaaagatccacaacttttctctgcaccattaaattagctaaatgtgaaacactactaacgacttcatcacaatactgtcttcaacctcattacctaagggttgaacaaacaaaagctcatcttttctgcagctaaataattaacacactgtggatgcagcaacaagggccatagcctaaccatttctaccgtaccaccacatcacgcgcgcgacactccccagatttgatatatcgatcgagtccgccgtggcacatcgctagatcccaaacttctcggatcaaaacgcgggcaacgaagacgccggagcacagagcggggaaggagagggaagggggcctcaccgttggggccgagggaggtgcgggtgatggcggagagctcgcggcaggcgtcgatgttcttgaggacggcctcatcgaggccggagaggtgcttgtgcccctccttgagcatggactggatcccgtaccccggcatcgcgcccagccccaccatcgtcggcggcggatgagatcggtgacggccgcggaggaggaggagaaggaggcggcggcggcggcggcggcgaagcggatcaaaaaccctagtgtgggcgggcgatgcgcgagtgttggggagaagggaaaagggaggagggagaagggagaggccggcgagttctagaaccagcaggttacctgtgggcctgcattttgggccaagcctactaggcccaaatatcctcgaactgtaggcccgaaagctaaatggactgaaatggaagtgatagagctgaaagttaggtaaaaataggcttaaaacagggaagacagattctaatcacccaagtggatgtctatctgtttattgcatgataaataaatagttataaaaagttaaaaataacataatagatcaatatgtaatatatcactctataaattacaacttgtagaagttgaattttaacttggatgtttatggagttacatattacatattgatcgtcatttttttcaaatttcttaataactatttagattacgtattaaacgagtggacatccacttgggtgattaaaagagtttcccttgaacaggcccaaaagtgaataatgtaggcttggagcaaagctggtttttgaaaccagtgggctaaaactagttttttaaactaggtacatggcctgtttagaagagctctagctccaaacttcactttagaggtggagctaggggctttaggttgttccacaattttactttaggttcaggttttgttcgagcgatcttttgttcgacatttgctacatgtgtatgagaattcatcaaattcgaaatgatcaaatgcacttttatttattcacgtgccaaatatatacaggcaaatatcgtatcagaatatcaaccgagaagcaacggtatttacgggaataaacatatattccacgtaggagtactatatctttgttatctaggacagctgggcaaatagaagtttcatcagccatggcggatgatcaagacttctagaacttggacttgaggagcttgatgatcttggcgtccacctggaagctcttggcgaggacggcgtcgggtatctccgggtcggagccgaacagcgtcgacccggcggccacgacgccgggcatctggctgttgaacgccgtgatgacctgggcggcgacgccgccgacgttgtactggaagtggatcatcccgcgcggcacgacgaacgtctccccctcgccgagcaccttggagtagaactcccccgccgtgctcacgaacccggcgagcaccctcccagcgacgacgtggatcagctcggtggcgcgcgggtggctgtgcagcgggttgacgccgccgggggcaaggtcgacgcggccgatggagacgccgagcgtgttcagccccgggaacgtctccgcgttcgccgccgtcacgttgaacccgaaccggttgtccgtgtcgctggcgacggcgaggccggcgaagaagaagtcgtcggagacgaccgtggacgccggcttgcacgggaagcccgggtaggccgggcacgccgccgccgcggcgtcgccggcgcgggggacgacggccacgcagaagtcctgcaccggctcagggtcggcgatgcaggtggaggctagcacggcgagcgccgccgacaggacgagcagtggcgccgacgatgtcctcgacatggctccggtgtgctccattggtggcgagtggtgtggtgcaaatgcaatgttatataggacgtgaggaaggataaatatttggaggactttgaactgtctgaatctttgaagggtaaagggtttaaactttaaaagtcctctctgttagtgcagtactactgattacagatgatgagatgagtactctgacttaccgtgcaaaaaatgactactcagcttgagagattgacaaatctttgggtggtaattccgtctataattaaccatcatttcgctgcattagttgctatcttttagagagctgtgttaagaactaactcttcaaattgtggttggtgaaatatgagaggaactatattgagaggcaaagttttcaactatggtgatttgctcatcgagtgagttccacaagctgatccatgtactgctcctgagcccacaacttgcccttcttcctccaccataacgcgctgcacggctgcaccactgcggcgacgtcagtttcggtcgagaatgagctgttgtcatagacctctacgccgacgcctctctccggcattggcgcattgctcaacgaggccctggttactttacctatcttcactcatcatggagccgcgcgtagtctaaaaatgttatttgtcgtacatacgttctagtgcacactttcatatgaaagttttttatagaacttcttcaattaaagtatttctatgaaatatatagataaatgtttttccgggtgaaacttttgcggacaaaaaatttttggatgaaagtttttagggggaaaaaagggatttgttgggaacgcaagtgcgttaaatagtagtccccatacaatcaccaaatcaccaagaccataaattgacacatcgcatgccaccagggcataataagattataagtcatcgcaacaatattcaataatctctacgatatactatattttaaaattttagactcccgctatatgtttcgtgccaagaccttcaatttctaactacgaccttatgaatcataatccgattactaggatcatccaacgcgtactgccactttccagatcggtgaaatggccatagttgagaactttgcctcttacaaaatagtttctcacacgtttcaccaatcacgatttggagagttagagttctcaacaactatctaaaagataagtaattgatgcaacgggataatgattatacacggaattaccaccgaaagggcctgtcaatctctcactctgcgtagtcgtttttttacggtaaccatgagtagtcactagtgattaatactgcgttaacagtgagtcagagactttttttttttaacccttcaaatatttttctttcattctcgaaaaaaaaaatcctttcatcacctcttgtatagcatgaaaactctactcatcccttaaggggatatcctattcttttttcatgtcacttaaaaaatcataaaaaataaaaaaatagtgatatatcacttcacaaacatacatatttaaatttaacttataaaagtagaaacaaaaataataaatttgactataaatagaacgtgtaatacacgatcaaaattgttatctttattttgaattatataagtcagattttaacttgtatgtttgcgaaaagatatatcatatattgatctatcttgataaattttttaacttttttataactttttgaacgtcatgcacacaactagagtatgtcccatcggagggacaaaaatccacttcctatatagcattgcacccgaatatcaacctcgtcaccaatggagtgcactgaagccatgtcgaggacatcatcgtcggcgccattgctcgtcctgacgcctgacggcggtgctcgccgtgctagtctccacctgcgtcgctgaccctgagccggtgcaggatttctgcgtggccgtcgtcccctgcgccggcgacgccgcagcgggctccggcctacccgggcttcccgtgaaagccagagtccacggcggtcatctccgacgacttcttcttcgccggcaacacggagaaccggttcgggttcaacgcgacgctgggcaacgtgcaggcgttcccggggctgaacacgctcggcgtgtccatcaaccgcggcgacttcgcccccggcggcctcaacgcgctgcacagccacccacgcgccgccgagctggtgcacgtatcgtcgccggtagtatactcgtcgggttcgtgagcacggcggggaagttctctccagggtgctcggcgagggggaaaccttcgtcatcccgcgcgggatgatccacttccagtacaacgtcggcgacgtcgccgcccaggtcatcacggcgttcaacagccagctgcccggcgtcgtggccgccgcgccgtcgctgttcggctccgacccggagatacccgacgccgtcctcgccgagaactaccaggtggacgtcaagatcatcaggctcctcaagtccaagttctagaagtcttgatcatctgccatagctgaagctttgacgcgcaaaagaattgcacgtcaatttctccgttttatattataagactttatagcattgtccacattcatatatatgcataaaattattagcatctatatgaatgttgacactataaagtcttgtaatatgaaacggaggggtagaaggaaatggctgaagctttatgtacatagctatcctatattatgtgctctttgcactgatagctgtcctagattacatgtacgtacatagtgcggacctatttggcatagcttctgctccaccccttatagagctggagctcagacaaacagtttcagctacataaaaaatgggagtggagctaggtggagctctctcacaaaatgaactttagttgtggagctgggtttaggtagctccataactccactccagacctaactcctagagctaaatttaggagttggagctgtaccaaacagaccctatatggatacatgtttattccagtaaatagccttgcttctcgcttgatattatactctgatacgatatttgcccatgtatatttggcacatgaatgaataaataataaagtgcatttgattatttcaattttgaatacatattttatgaattcagaaatataacttgagaataagacatcatgttagaatgtgaggatagaaaataccatattaattgaatataaagagaaaaatagctatggcaatacatgctactattggtatatatcaaatctcattcggtttgaggtagcagttcagataggaactgtagacttttttccattggtatatgattcagacttccaaatgggcgcaggctatattctgacttgcacaccaatttcggaattttcgttgcggcccatttaggggaacagcgtactattgaactttctggcaaaagtaggcccagcccgatttgttactgtcatatgcttctccttccgccggcgtcgatggctgcttcgccgcgcgctgatgggcggcctcctcatccccgccgggatacgcctccgtttcctcctcctcgaatctctccgccgtgcaagtttgcgactctaaggcagtttatgattcctcgccgcctcctcgaatctctccgccgtgcaagtttgcgactctaaggcagtttatgattctcgccgccgcccgcggcaggggaaggattccgatcaccggcggagaaccaagcatggcgccgccgcggccgcgtcatggtggaggaagatgggaagatgcgtgaagggttgggtgcaaaattagccgtggctgccgtgctgtcgtcaaattcatttggtaaattcttctctaaattgttgagaatttgatgtctttaagtgattttttccgatatttgctgcatgtataggacaattcaaatttactttattgatgtgccaaatgggcaaatatcggaccaaaatatcaaacgtgaaacaactctatttactgtatctaggacagctaaagcaaaacagatatgctgtagccatggcggatgagacgtcagtgtcacttcttgaacttggacttgagcagtttgatgatctcggcgtccacctggaagctcttggcgaggacggcgtcggggatctccgggtcggcgccgaacagcgccgtcgcggcgggcacgacgccggggagctggctgttgaacaccgtcatggcgcgggcggaggcgttcccagggttgtactggaagtgcatcagcccgcgcgggatggcgaacgtctccccctcgccgaccaccttggagtagtacttccccgccgtgctcacgaacccgacgagcatccggccggtgatgacgtgcaccagctcggcggcgcgcgggtggctgtgcagcgggttgacgccgccgggggcgaggtcgacgcggttgatggcgacgccgagcgtgttcagcgccgggaacgcctccacgttgcccggcttcaggctggccccgaacgggttgtccgtgctgccggcggcggcgagcccggcgaagaagaagtcgtcggagacgaccgcggacgccggcttgcacgggaagcccgggtatgccggcgacgcctcgccgccggcacggggcacggccacgcagaagtcttgtatcggctctgggtcggcggcgcaggtggaggctagcacggcgagcaccgccaccgtcaagacgagcaatggcgccgccgacatgtttccggtgcactccattgatgatgatgaggacatgaggtcgatagttttggtgccaatgcaatgctatataagtgcatataggaggacgtgtggaaaggacaactttgtgaaagctttgaagggatcaaacattaaatcactaaatacataaaaggctctgttagtattgtgatcatcaataagtactctttccgtcctaaaatagaaacactattaagtcaaacatttttaatttttactattaataacaagaaaagtagaaagatcaatcgtataaaattgatgttactaaatttatcattaaacaaactatcgtaacatgtagttactttttatttaaaatttttatagatattattaatcaaagtagcatatcaaagattatccaagaaaaaatgctaactatagcgagagtgagaaattgacaggccctcgggcgatttccatgcataatcatcatcaagctttgatcattactttattggagagttgttaagtatttaagttgtggttggtaaaatgtgatcaaaactagattgtgagagaagctttttcaaccatgtccgatttgtcaaggggcagcgcgtcggatgatcctggccgtcggatcgcgattagacggctgcatgataagtggagattggtaaatcgtcctcatcgttgacggactaacgagtgacgtggacaggatgtggtctggtagaatagacctggtcacggagtgcgagatgagcatattgttttacttattcttatgttaattcgaatcacttattactccctccgtttcatatacaaatcattttgtttttttactagtcaaacttctttttaaatctatagaaaaatgtagtagtatattaaacacaaaacaaatatattattaaaatatatttaataaaactaatttgatattttagatgctgatattttttatataaaacggagagagtactaaataaaagatcatttgtgactaaaacttttatatgcatatcattagcaaactcaaaataaactatgatgaaaaataaaaaataatcaaattcaaaattaagttttaaaaacaatgaagaccaaattctccaatggtaagcgaagtcctcaattccgtgcacttgggcgaacccaccactaaaaaaaataaaggcgaaagcgaccacactgtaggaagaaaggtaagcacaagtcaaattggttggcaggtagcaagcgcgtgttcagtgcatgttggcttgttgctaggctactatggtacagatgaatcttcagtttttcagagttcatcatcagcctttggaagacaatactcttttcagatgaacaatcagcacaaagtcagtctacgcgtatcaagatggtacagtatgtttccaagaagacaaactacactgggtcatacatttctcaccaaatttacaaagacacatctctgaacaaccgattcaattcaaatattttcctaaggccgcctttggaatatgcagaatcccattccatccatgagtttgggccaggattttagttcagaatcctggcctatacacatggatggactgggattgaggcccatccaaacgaggtctatatactggcatgtacaccagatggggaacaaagctaggagatactcactcctatacaagacctaaggagagaatacaacagggaaatggagaaactatttcacactcactcctatacaagacctggttactaaggctactatgtacactaggagctgccatgggatctgaccgacgatatagattgcgctgaaacggaggctgtcgggctgttcacctccctatccccattggcagttcgagggttgccactgatcctactgatagtgtcattagcaacgtcgatgaaccaatcgtcgcttggaaggacactgcagagaataaacgggtatatcatcttcagttaccaacctttatgaataaaccaggaattgcataatcactagcctattccagctatgaataaaccaggaattattatctaaaaaatgaataaaccaggaattgcataatcactagcctattccagccagtttctggtatgtgaggaatctattacaattgtaacatggagcaaaatacatgcatgcatccgattgccattacagcataacatgcatagatattaatattagcacctcctactaaatacagtcggactgaaatagatttattaaccgcaaaaggatagatgcaagtcagatagatagtaacatacctatcagggttcatccctgtagcagaaaatgctgccattgctctatcaatgattttcagtatcacttgatgtacgtgccgagataagaaacggcctcgcccggaaaggatgacaaattgcatatccaggtagaactgaaaaggaaggtgaaaataagaataatagttggtgtcataagatcaaaacaagaaaaaaagaactcacctgctgaagtccaaggggacccagagcccttggcccctcttcaatctcttcccaaaagctctggtcctctgatagccacagtatgactgtttctgtaagccgcatcagtaggaatgtagcaaacctttccctaccaacaaacaaatctgcagcaatgctcgccatcctgtttaactttgcatataattcctgcaacaatatatgagatgctgcaacaaaaggctaaagtttcttgggtagatttgcaagcagcatgactgcccaagtttcatgagttgtcatctaagctttacattaacaaaatttctgcctgacaaaatactgaagtctattatctaattcaaaattgtacctttgttatatttctcaaagtgcaaaattttctggtttcaatttctaaataaagcatttcttcgaacaaaattgcaagccagccagctgccaaaatctatttttggtgacaactcatcaggaaccaaacagagttctgtactgttggttctacaatttggttgatcttgttaatgttgggctagacataccagtataatagcacaagcaataactaggaaattatttgcaagctgaatgcaacttctttaccatatgagtgaattgcattggtggtacatgaacttgtttggtgggtgcaatctagtggatgaacttggcaaacactcgttttagtgcaaagacttgtctagtgtgtgcgaaccaaggccaaaaggacacgacaaggccaattttaccaagtttatgctgattaagacgtaatgtgtacatgtcaagtgggcatgcatgaaacatgctatatttactttatccttctatgtatctaacccttgcatcattcctcggtttttcatgtcttctatgtatataaacaagaaaggaagtgctatagagcatagattcagaaaaacaatttggtttacttattttacaacaattcatctaaaaatcaatatattttatagatcatagaagaactacctcaatgatgaatgtcataatgaacctcattcttcaaacaaatataagcagtaatgtttatccagatagttgttaagggcaaaaaatttatacggacctgaaaaattagagatggaacccattctggctcttcaacagtattatccatattgatgtacatttctgcactcagacgggtgtcatcatcttccgtgaatataagatcaagggcgtgctgtctgcagaaactatctttaagtttatccacaatacgttgcagcttctttttccattctcgctgctctgctacacggttttgcctgtctacactttttttacgaatatcattcacaccagtatggtttacagacgacaacttcatagctgctctaggtagcaactcttcagctagtaaggatgcattagcgaacaatgctagctgctgctcctcagtctctgccactcgaacaatcttatttcctaaaccttccaaattcgcttcatcatccagtgagtgtggcagagcacttatgagcagattgacatatgaattgaatattttcagaagcccgtccattgcagaaccacctaactgcaagctatgcagtgggccaacatcctcaaagaaatcctgcaaaataatacagtaaaacattaaaagaataactttatgtataaatcctcaattacaaaggctagaaacatttgtcaagcaatagaacattacctgaaccattgaactgaagcgatggccactgtttgagagcttaggttggagcaacaaactactagcagatgatctagcaaacgtccgtataccagatggaggataggtgagtacccagtcatcagctgcagctaaagcagcagtactctcttcaattctcctcaaactggactccagtgcttgctcaacagagggtttgaattgcttcatcagaacagacgaaagtgacaaaccacgagtttccagcaaggaagaatgaccaagtgagatctgaatacattcggcagcagctctcaagcccccagcagccacacaagcggctaaagcatgcctctttacaagtagtgcaaataacattgcttgttctgtagcccatgtaatcagttcagacaaataagacggttcatcaccaaacagttctaaagagtcactgagagcctgggctataacagaaaaaacttgccgtgcaagagatgcagtgtatgccccactgtgtgatgtgctagacggatgtatagtttgcatgctgcattgaagcctctggttgtgtgcactaagcaacaaactatgagcacggggtccatcaccgagtctcttgagagcagaagctgaagcacgaagttcaacgccacgagtagaagactggcaagcagcttctgctagctgatttgccaatttcagacgattatcagagatagccctcttcacggccagaatgtcagctgtggtgagtgtctgtttctgtttttcatcagcaacgacacgttctgcttcatccaaagcatccaatgcttcatccactcttctctcagctagcaaaacatcaagcatctcagggaaatctgtgcaccagttttgtatttctgagggctcctggtcttcatctgtcccctcttctgcagagccttcagaccctgtagtcaaggaatcaatatgaaccccttcagatagaccacgaattagagctgactgtgtacttagcagatttctgacagatagcagctccctttcaaggtctgatatctcctttgatgttctgaaaaccaggagattgagttatcaacattttatccgaaagttatgaactggataaaacagagaacaatcccaggaagtaactaagaaaaacagagaaataccagatgtgaaaaaaaaatacaattatgattttgcatcccacaagttttatgacatctgcatataattttgcagaaacgacaaatccgctgcctacctttcttttttcaataattctttggattgtgattcttacaaaatactaattcaaaattttatgaacttgtatggagtgcgcagcggttgagatgccaaagattagcaataaacaaagctagcaggcatactcattttagagaaacaaaaagaataaaaattggagaataatcagacacgatactctgagtccagggatatactcccttgggttagattaaaatttcaacaattgtgttcacaccttatgaatgcagcataattcgcataaacacttctacgcatctcttcagaagaagccttctttaggtcttgcagataagaacagaggtgtcttatttcctgtcacagtttttgagcatcaatcctgttagattttccaagcatgatgtgccttttactaaagtaatagttcaagctctaaaacacacacagggagcatgcaaaggaaactcaacatttgaagcctcagaaaatgcacacatgcatgatacggcacaactgcaaaataggtcttaagtgagcataactcatgcagaaaaggtagaagtgtaggatcatccattcgttgctacccaaatcctttgacaaccatgagcacaagtggtctcccgcacaaaacaataggtaaaagcaatttaaaggcaaccatttatctcatatacaataaacgccaactttctaaaacaaaaaaagaacccttacaaaatttgcgtacgattcatttcatcaccagagccgccataatatagtacaaactccggttctttgcaaatatgtgtaaatctacatgtggtcacttctctagaagataacataaaactaacaaactaacagcactctacttcagtgctccctccaagctccagacaaatgcaaattcaaggttattgacaaacttaattcgacctcaattcaactacgcaagcatgcagcgcaaccagaaatttgtcantactggccagaatcagtatttctccgcatcagagtaaaaaaaacctgtttcataactagtatctgaacatgaaaaaaatcaaaccaataaacatatctagttccatgcaaccaccgttttccctctaagggaaacaatcctaataacgctcaattcacactttcgctagttcaaatgcactgggaaactcccgacaccgtatccctcacacctctcgaacacagaacagcaaaagcgcgtgtgaacttccgaccaaaattctaccactccagtttcctccccgtttcacgagtggaccaatccctttaccttctcgttcatggcgtggcacttggactgcacgtacgcgtcggggtcgaagttgtcggtcttgaagatcttcatcttgtcggcgagaggcaccccgccgtcgccgcctccggccgtagcgttcaccggcagcacgccggagtgcccggctgggcgcgacctcgtcgacttggcggacgacatcgccgcgcgcaggcgaaccccaccgccgccgccgccgccggcttcccctctccttcctcccgcgtgattaagaagcttctagaagtggaaccgctgctcgattgagagctccgctcgcctttgcagctgcgcggattttttttttttttgggtgggggatgtttttctttgggtacgtggaataatgaggagttgagttggacggttgcgaaaggaagaaagacatatggttgttcttggaatgtctctggagactgggagtagaccggtactactccctccgtccatatatccctttaaaatcttttatattatatgattatattatatctctttaaaatcttttatattatactaacttcgttttttaatagatgacgccgttgactttttcttacatgtttgaccattcgtcttattcaaaaattttatgcaaatgtataagatataaatcacacttaaagtactatgagtgataaaacaactcataacaaaataaattataattacgtaaattttttaaataagacgaatggtcaaacatgtgagaaaaaatcaacggcgtcatgtattaaaaaacggagggagtagaacataacgatcataaaatagaatttttagtgatgagatttattttttaaaaatatacttttaacgaaagaagtgagtaggtagtttatgtttatttttaatttttttaacacgtggagggtcaaagattatctaaaaacttttcgtagaatatttgaaaactaaatttctttgttttttcagaaactagctgggtggcccgcgcaattgcgcggctagcacccaaacaaaatcatattattttttaagtatgattttacttaaatttattgaatagatatctcgttgtcttaagactttgaaagaccaaaccttatcatcctcgtgtttctaattatatagtttttaaaagtcacaccggttgctacctcttatgtcatctccttctttatttgcttgctcgatctaccactattttctatttattcttcttgaaagctttaaaaatcggattttacagtttttagagtttattgtcacgttgggtttcatttttataacttctagagtcccgtcaaatgttgtcattatactcctctgcggcccgtccactgtctcttctctttattgtcattgagaatttaaaaatcgaacataattatcgtttgggttcatttttagtttctagaagtcccgccaaaccattagcggctttgccattgtactcctctacggctcgccctttgcctcctttctttattgtcattgagattttaaaatcgaacatgattatcataggtttttttttacttttagaagttccgaacctttaaaaattggacttgtagtttcattcttttataatttttagaagtcccatcaaacgatgccactatgcccctctacaacccgtatgccgcctactctttattatcattgtgattctaaaaattaaacataactatcgttggaattcattttttattttctatagttacaggctctgcaactatactcttatacactcagcctgctgcttctcctttttattgtcattaagattttaaaatcgaatatgattatcaatggggtttttttttttaactttctagaagtcttggcaactgctttactcgtttgcttcacggcctgcctgacgtttctccttttaatcgtcattaggattctatttggtgttttattaacaatttttatatgtcgtatcaaccgccaccactctactcctttataggcatgttacttaatttatctcgtcatgtgttttagatggtcttttctttcaataatatttatttttatcacaaattttagttatttataaattgtattcctaattgaaatcttatttttctttttctaatttcatcttttttaaaaaatagttaataccgtattgtgttcttttaatgttttttattttttattttcaatttcagttgtttcaaaattgtattccttgaactctcttttattttttctaattttggatattattttattttttattctaaattttaattaatctcgtattgggttcttatatggattcttctttcaatatttcttatttttaattccgaatttcagccaaatttaaattgtattcctacttgaactcttcttttattttcttttgctaattttggatttatttatttttattccgaattttaattaatctcgtattaggttctgacatggactcttattttaatatttcttatttttaattctgaatttcagctatttttaaattgtattcctacttggactctcattttcttttctaatattagattttattttatttttatttcgaattttgattaatctagtattggattcttatatggaaacttctttcaatattgcttatttttaattccgaatttcagctatttttaaattgtatttctacttggattctcctttccttttctaattttggattttattttattttatttttatttctaattttaattaatctcgtattgagttcttatatggaaacttctttcaatattgcttatttttaattccgaatttcagctatttttagattgtatttttacttggactctcctttttttttctttttctccgattaatgtgggaatttatagcccacacagcgaacgtggtacctcattttaaggctttttaataatataatagatatataggatttttttttgcataaaatgtatcttgggaaacgtgcaaataaaaaaaatcctttttaattctagtgtgaatgatggattaatactaaccacaagatagttggacaatatcacctagctaaaagaaaaacacaattacacaagaacagttctacaactcaaagtatggttggactgttggagtaggagccggtagtctgtaaggagtaactattgaccgaactttttacattttcaacaaggtattgttaaccagagttactataaagaatcatcgagggatacaaatgggactttttccaccaacggacctgttgacccatgtcaccaccctagccacccaatcgaccttccccatcctctcaacctcgactcccgtctcctcgctcgctgcgcgcatcaatctccatcctaccaccagcaatgatgcgggtatattattccgcttccatcacacttttgtctcgaatttgaattcaccatctgcaccgatctccatcctacgagcgccggcggcaccggcatagccaaacggtttccataaaatacccactcatatagtcatatgtcttttttttaaaaaaaaagtttggtactgaaacctcaccgaatcataatcagataatcctaagttctaaccgattccgatttgaacaaatttgactattttcagttaacccttacccaacaattttaatttagtttcaattttcttttatggttcatctagaaatccctctaaacgatcttttttgtgcgatttctttttcaaagtaaaaacgcggagctgagagaagacgacctgaccgcccgcgtactccacctctaacctttgccattcccctgtcttcttccatctccaaatccttcttccctaatccccctcgccggcgaagcgcggcggcggcggcggcgccttcttccctaatcccctcgccagcggggagccgcagggcggcggaggcgtgcgtcggctgctgctgctgcgcgggcgggggaggtggggagagatgcacagatccgcgggcgccacgatggcgtggaacgtgttcaggttctgcactgcgctgagggggctgggctccatcatgatcctgctcgtcctctccatcgtcggggtcacctactacgcggtcgtggtgtacaactacggccccgcgctcttcgccggcggcgccagcaccctcctcgcgctcgtcgtcctgctcctcttccacttcctggtaactattggctcgaactcttaaggggggggggggggtttgggtgtcaaaaacggtgaaaacgattagctggttgggtcgaatctcgcaagtagacgagagattgagtgtttttggagcaatgttaggatacaggtcgaaaattttgttatctgtgttggttgtttttttttggggtacttggttggagtggctatatgcaggctggatactgatttggataaattgatctatagcgaccgtgatctagtaattgtttgcctaatatatgcttctgtacaaaatactggatttgccgataaattgatctgttgttgccatggtataagtaattattttcctaatatatgtttctggacaaaatacatgatttgcctatgatgtatgcttgctacattgttgaaatggatatgggttgcagtgatagatttaaggataaaaaagcggcagaatgagttgataaaatgcaatgttgatgctatattgattagagaaccgcaatgttaactgaagtttccttgcccgaaatagttgattataaatactagcccccgttatattggacatattcgcactgttttgattttgtttttttccacctttattttgataccaattagtactaagtagccctgataccaatcagtactaagtagccctcgttgtatttcctcagattttttgtactaagtaggagtggctacgagtgagctggatacatgttcggacaattgagctgttatgtccatggtctagtatttattttcctatcatgcttcttgacaacatattagatgtttcctgatatacactacccacattgttgaaatgcggatggattgtactgagaagttaagaaaggaaagtgcaaaatgaggtgaacaaaatgcaatattgatgctataatgattaagaatcacaatattaactcaaaaattggatgcgaagaatagttgactataaacattagccctgtaatattaaacattttcgcaccgtttcaattttttcccgcatatttgcttttgacactaattagtttatttctcattgtagcttgttatgcttttatggagctacttttctgttgtattcaccgaccctggttctgttccaccaaattggaatctcgactttgatgaggagaggggagaaactgcccccctttctggcttagatttcaatagccaggtaaactcgcaacaatctatcgctcacaatgacacaggacatccaagggctaggtattgtaggaagtgcaaccagatgaagccacctcgatgccatcattgctctgtttgtaagttgttgatttattcttcaggatcaattttttgttgttctagttattatgaattgtatagtcaacaatattgtgtatttatcactaatcatggtttcaggtggaagatgtgttcttaagatggatcatcattgtgtatgggttgttaattgtgttggggcactaaactacaaatactttcttctcttcctggtatgatattactgtaattgatatatttcttaggatgtgtttagaagggagataggctttggagttttgttatttttaacatattcacaggctgttatttattgtcatgctagtgaaatatgcagattttttttttgttattgctttaaccctatcttttgcaatgagactggtttcattttgcccagtctatttttatgcactgtgttgacaaatcaagatcttatacagcaaactatgtccatccaccccaaaccacacacacgcacgtgaaatgtataatcaatttaagccaccatgaatacttaaaatgcttcttctattcgatgttattagctagaggggtggatctatgatgcaaggacatagatgcgtcaacacgacacaataccgatctgcggattcaccattttcagaaaaataccgatacggcgacacgtctacatattttaataaaaatactttcaaattctcaattatttacaactaaaataatcaataatgtattgcaagcaagtacaatgtacctcaaggacaatccttagctcctaaaaggatggcgctttggtgggggtgtgtagggggatgtgatttatcatgtggctatgtgggccgggccatatcgcatatgtcatatgtgccggagatgaatcgaccatgtatcagaacataaaactaattatttttttctatttaattttacaatacttggtcgatacgtatcggaggcgtattgaagatgtattgatatcggacatgtcattggtcactggtgcataacgtttccatattattatgtttacaagctaataaacaagctaaccaaatattaagtactaaactaatggagacgcaatccaacaaacagttggtagctcctctgtcatgctgctgacccactgcatatgcatcttctgtggcttttgtggctttgatgcatcagagtaattagtgtgttattgttgaatattaattattgcttttctcatctacttggggattccacttatatagcagtgaagaaaataatgcaaaaaaatataaatcagagtaattagtgtgttcacttctctgataataacatattaatattggcagtataaatgctgctgccttggtggtgctttcgtttgacttattttggactactatccttttttcttccacacagctattcgatcctttgatttctgaagctgagttcatgtttttaatgattccatgcagttttacaccttccttgagacaacactggttaccctttctctattgcctcacttcatagccttctttagtgatattgatatcccaggaagtcctgcagcacttgcaaccactttcctcacctttggtaattgcattactttcattcatgagaaattattcttgggcacgtttgactgaggattggcttataatattctttttctctgcagtgttgaacctggccttttccttgagtgttctgggttttatgattatgcatgtttcacttgtttctgctaatacaacaacaattgaggcaagtatctagaatgtataattaaatactcaagtatttatcaatgtctattaaatacttacttttgatatctccaaggtgagattaatttgttacattatttttttatttaggcatatgaaaagaaaactacgccacgctggatgtatgatattggccggaagaggaatttcattcaggttaggctttcagaacatgttaaataatctgttacttcttgtaatggtgcaagcgcacgcgaaattatctttgtttaaaggcttgatacaccttgatgaggtgggattataggacatgcacaaatgcagatattttagagggaagccatacttttggcccctctactatcccttttgtttactccacctgttccaaaataaacaaacgtagtatagggtgtgacacatcccgtactaggtttgtttattttgggacagagggaggtcatattctgaatgccaatgctaattagaaaacgtccccagttatcaaaatcatgtatatgatggttagagagtggtcttggatgatatgacatcatatatatgatgcatagagtcataggctgatgtggcaaataatttacggaaggaaattaatgctcctttttttccagatgaggtaataaatgacatactgtattaaaaaaatgatgatgtggcaaccacaaaacccaaaaccagtcaagaaagctgctttggatgcattttgcaccaattccaacagttgtgtgatgtaaattaaatggtattaaagtacaggttgtaaaccagagtagttcagaaatcaaaagtggaccttttaccccctaatttagacttctgtggtagatccacccattttcactcctcattttattatcccatttcccatacaagtgccaaattttccttatccaaatagcggttctgcaaggacagataagggatgtgatcaacctccagggcaaattaagaatttacttgaacttctatttctaatttgtgaaaattgtatatattgttccaaacttctaatattttaagctgcccgtcatttagagttccatacatttcgagtgtggcattttacaggtgctcaagggccatgatatttatttaacttatggttactttggccagtattactaaaatataacccagcaaagccgctagcctggtagtacactagtactaattcaagttagtactatgtgttatcttcaacatctgaaatatgccttctttttcatttttatttctttttttgctaagcattctactgcaaggttgcaattcttatctgttaaagccctgtttggtagtgagtttagggggtggcaacttccgggttttccattagcactttctcaaactgctaaagggtgtgctttttgcaaaaaaacaactttttatataaaagtttctttaaaaaaaaaatcaaataacctatttttcaagtttgtaataattaatactcaattaaacgtgcgctaatgacttgtcttgttttgcgtgccatgaaaaaccccattccgacatcactactgaactcagtcagccacatgtgaataagtgaacataactttaacaaaaggcaaagctaactaaacagtgttctgttaccaggtttttggaaatgacaagaggtattggttcatccctgcgtactcagaagaggatttgagaagaatgccagttctacagggccttgattaccctgtcaggacagatttggatgggcaagaattgtgatgggacaatttcgcctgtgccctcacttcccatatgcaccaaatatgttccatgtaaattttacggtttccttccgatatcgtagagttaaatatttttaaaggtacaccttagtactgacagcattgctggttgggtactacatggcctccgaagagagtgttcccagaattacttttcaaaccctgtgtaattcacttgtgctgtctgattgggcaaagaacgtagaggtcttgctattgtggctaaaagaggcatgtgatgtaaattctttttagtgtgtttcagatgggtttccagatgtatgatgtacaatgatttgagctgtgcaatagacgtacagttattagagcatgacatgttgataagataacctgtgttaattagagaactggatgtttaagtgttattttattagtttgtcattttaaaatagtgcacccgttttcaaaaggaatatatgatgtattttgtttcgttacgacaaggctttggctaacaattgctctattagggtataatctttatgacgtaaaattgaatttattagatttatatttaaaagtacttatttaagattataattttggatcacataaatgttgttttaatagagccaagccagtgtaggttaaagtctagtactataacgcaacaaaataaaacagatggagttcatcggagtagaagatgaacttgatcggtacttgtttcactctagaatagaaatatttacaattgatctgtgactaatgtcccatccgactaacatgtttttttttccttgctcttctaatgtgaaaatctcttccagttatgatcattccgtgattgtttttcttctttgattgatggtgttgctctcaccacgcaagtcaccaatttcttctgtatgtaaaaaatgctccaaatttcgtctcatactgtgctcataaacttctatggcttgtaaatttttgtggagttttctgcttatgtgtgaaataatttgtccaatcatgccaccaacttggctgtttcctctttgaaaaagtccactttgactttcttacttgtgcgccgaatctaattcatatccctcaaccagaaaaccggatatgacgactcccaaaactattgaaaccagtgtaatttgactccctcagtggttttagagggtgattttgctgatgtgtcgctgacgtggcggtattgacccggtcttcgtcccacgtgatgcttacgtgacattagaatttaaaaaatatatgtgagacacatctatcattcacatacaaaaatatattgtggaacccactgacatgtggggcccacctccctctccaacccttcttcctcctccttctccctcccttctctctcttccttcgagccgcaggtcatgcagcgacgcgtctccgcgcgaccggatctcctatctctctttctctcccctttctctcccccttcgccgtctgcggggagagctggagcgacggcggcggcgggcgagggccagaactgcggcggtgcgtcccatggctggtggcggccgccgcggccgaggaggccggagacgagagcggcggcagcgggcgggcgagggccggttgcaacgccgccacccccgccggcttccgcgacctccactgcctgtccacccctatcaatctcgactcagcaggagaaagagcgcctcctagatctctcctctaggccgaccctgtccccgtccgccggtctgggctaccgcggaccagctcctcttcgtgccgccgggccacccctccgtctccgtcactcgagagggaggagtcggcctctccatctcgggatgtcggcgctgcctcccccgacgacagagacggactcaggtcagcgacgcacgcacgcgcgctttcttgccataaaaggagcaagcaagacgtcatctcctcggacatcacgattcacgaagccaaacccttctttatccgatcatcgagcatgccaaccagagtccaagactgtcaattctcggcaccagcggtcgagctttctgatccatcgacgtcgacggtggtggcctcggcgagcatggagatggagcagctcacagcccgcttcaacgatgccgtcgctgtgcacggcaacaactagctgctgctggacgctgccgccacggcgccacacgcggcggtgggcatggagatggcggcgccggggcgcggtgatgatttggaggagctcatcacccggctcgtcgacgtcaccgttgttgcgctgatgatttggcggcgctgttccactactgcggctcggcggtcgccgcgtgcggcatggcgggggcaggcgttccggctggtgcggttcgccagctggtgcagtatcacccagttttttttaatgacaaataggttccacagatttttttttaattctaatgccacatagacgccacgtgggacgaagatcgggtcaacaccgtcacgtcagcaccacattagcaaaaccgccgagggagtcaaattgcactggtttcaatagttcatagagtcgtcctatccggttttctggttgaggcctgaggggtacgacttaagattcggcgtataattaagggagtccaaatggactttttcctttcctctttcctgtggcgcgaggcagagcgtgaggcatacttggacgtggtgggccgggcgactaggcccgtgtcctagtttgtgcataaggccttggtccattgcattaagagaaaacaaaatatagaaatacacgtgtaaaacaaatgttgattaattaataaataataaaactttgggggctgcctacggctcgggcgcccgatgatttggagaaaaatcgggcactgacgtcatgctgacgtcagcgcccgatttacgtgtaaaaactaatttaaactgatttttctcttaaattacttatccaaattatgatccgattgcaccattaaattcgttgcaattaaatcttcaaaacaagaccacacgtggatatattccgacgacaatttttttaagcttattattgaattatttttaaatgttgcacgatgttccaccaagtatatcggaattgtttcactaagtagatcgaaaatgtttcactcatttaaattgggtattgtttcaccttatataaaaacaatgtttcagcaaatagcgaaagattgtttcagttcactgcaacatttgatccatacacagtgaaacattataagtgcactaggtgaaacatttttgggtggaacaaaaaataaaacgaattcccttaatagggggtttccaaaatatgtggattttttgttgcaatggaatatttcagttcactgcaacattagatatatacatagtgaaaccttgtaagtacactaggtgaaatattttttatggaacaaaaaataaaccaaaattccttaatagagggttttcaaaatatgtggttgatttgttacaggtggggacaggtattgtggtggggccagcgacatcagcgtgcgcaggggcgggggaggggggagcgaccgatttttcctcccgccgcccagtcacccgacggccatcattatccaaaactttggcctgacttcggctgtgttcttctcaatgagttgggaactcatctcccaaacacgtaaaacaaaacgactcattagcatatagttaattaagtattaatagaaaaatggattattgtgatattttaaaataacttttctatagattttttttaaaaaatatatcatttaacagtttggaaaacgtaaacacgaaaaacgtttgaggaaaaaacgactgttcttcgctccatgctcgcctgagcacaccaactcatggtttctcagtttctcacatatgctgaagagtttatccctccagcatctattttttttctctctttttaatcgtattgttgatgtgaattatttgctccacacgcctctgaaaatgtggcttctttaacaaaaacatttctttcattgaattacttaggctcatttgtttaaaggtagtatttgttaagtttgtttctaaaatgtttaattcatttatataattaagtagtcaatctatgataataatttagcgcttgttcactttgctatcattttcaaccttaccaagttttggcattgtcaaattttggtaaggttatcaaaatttggtaagattatcaaattttagcaagatttcatatgtacttactaaaatttagcaacaaactaaatgtagcaatttttttaactttacaaaaaaaatgataagattgaaaatggtaacaaagtgaacaagcccttaacgaatggtctgcttcaaacgctactagaatttcttcaaacgcttaacatgttaccatcaaagagaagttctcaaaaaggacacacgatcaacttctattacacacccttccaatctcttgaacataacccacgacaaactgacaaaagttcttttaaaaaaatgaaactgacagtacaaactcgacggtcgacgccaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagggctgcaggaat

SEQ ID NO: 69570 - DNA, 14255 bp, Oryza sativa
  unsure (1)..(14255): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcacctatatttatgggtggaaatgggagagtggaaaaaatgaaaatgggatggtgactcattttttttatgatcctcctgcttgcacttttattccagagaacatcactatactttttttttcatcatgcttgagaaaatttgcttcattctcttttgagcagagttttttttagctcatgtctcatttggcatggatcattagaggagagaccatacaatgtttttagtctttatttggtggatgccgacttctggtgtagaagtttagcatatgaaagtgaatggaatgtgttgctaatcctacagtgcggagaaaaagcaaaatttttggtggctaagtgcacaagactttggtcatgagaatatgaaaataatctaacaagggtcacaaccatttagcaaaactcaaaatgatagcaagcagcatatgtataaggtttcgtcattaagattgacatatggctttggtaggaaaggaacaacattgaggagtatgcaaagttattttattttcctttataaattccaagggttcaacatcaagtgcaagtttcatatcattaggccatctctcattaatcaataacttagataacacgtggtcccatgagtatgtaagtcatagaaggtgtgtgcagggaatagaaggtatgcaagtcatttttacaagcaattcggagactctagttgatcatgtcaatactcattttaattgttgagttaattttagataaggcaaaattaatccaactcaaggaattaaggatatgaaggataaacgtgcaaaccaacgctcatatgtgagtgtgaagacgtgcagccttgtgcaatggttgcttcgtctcatcttgtgaatgtgcaagcgtcacggtgtagcacagacatgggtaatcttgtatgtgaatgcgtcatgtgagcacaagatcaccccacacttgttttcgtacctagggtgcttcaaaagacaaaaagacaaaagaaaaatgtaaaagcaaaatggaactcactcagtgaaacccgatgagtcttttattttggcatttcatccaggaggcaaaggcggccttgcagcaagctccagttgcccaaatccagaagatcggaaggcatagtaattttgtaacgcatggtcttgctctactcagcctatgcctgaaacaaagtgttgtttggctctcaggctcccaagtgtgtttctgaacgcctgtcctgagattgtaatccagtcgtcgtttaattaatatatttctttcccccgagaaaaacataaggagtaagaaaatgtttatgaaatacttactgtttggtacagctactgagagacacttatggaatgctttagaaaagtgaaatcacatatattggaagaagaaagataattttgtataaaggtactctggagatatgtaaggctaaatttgtgaataatgtttgtcttgagacccccaacatgtacatgtgtatggcgagcacaatatctccaacacagagaaactgctagagcagtacaccatatacatatatacccatctgtaatagacataatcaataagcttgattttttttcctttaaaacttcaagacgtttgatatactatatgactttttcttccatgtagttctacctctcacaatctcctcatacttgtcatttgcctttagttgcagaagatgagtgtacttcgttggccactgctggagcgcaccagctaagctatggtggccattgatgatctcttgcgaaagtgaaggtcccatcacaatgctaacattttctcccggcataatcgtgtcttcatcaggttggcaaattgattgcacaacatctgagctcccacattccttcctgtattccagaatgatgctactaagctggtgctgctgcaggaattggtcaggcagagtctgcacgccataaaaagacatttagaatatgtcgatctttatgttatgcctaataaaacaagtgggaatcgatagaaattgggaatggatcaatggcatgtactacaccgttctttttcaccaatggcatgtttgaaaccatctaaattttgcttttataaatttatatcatctctattaaactagctcactttactccctaaagatctttctatttttttactatttgtctctttatagaagtgatatttcaagtaaagttttgaagtatgatgataggagtattccttttgccgcaacctattcttgaaaaaaaatatttatcactatttgcatagatttgaagcacctacgtctaatttaaataacaagattgaaacggcatccaaactataataaaaaatatattatgttgtcatacatggttctacaaattttgaacttaaaccgtgttttataaaaggagaaacaagtaaagataaatatttttttaaagagaatgaagatcaaccggaccaaatgggagagaaaccaacgtactacctccattcgtttcttacttacaccataaaatatgtaccgtaccttgtaatattattttaccgatggcatgtttgaaaccaactaaattttgcttttataaaattttatcatttctaaactactccatctgtttcatattataagacactttgatttttttgtcttattcaaacttctctaactttctaactttgatcaagtttataaaaaacatagcagctttttcaataccaaataaacataccatcaaaatatattcaatattaggtttaatgaaactaatttagtgttacaagagttgctatatttctctataaacttggttaaacttatagaagtttgacttaaaaaagttaaagagttttataatataaaacatagagagtagctcattttactccctaacatatttctactacctccattccaaaataacaacaattctagaggtcaaatacaacttaagagaaatataaaatgatctatgacccttattaaatgataggtgaatgaaagtgaaaggacggatgagggtaagctggaaaaatatttaaataagagttagttgatgtgattactagtacataggaatgcatttattttgggataaatttaaatcatgtaattgcacttattttgggatggggctgaggagttttttttttactattttatctctttataccagtaatattttaagtaaagttttgtgggatgatcataggattattccttttgcctcaacatttttcttgaaatgtttttatgactgtttgcatctaatttgaaacacatacgactaatttaaataataagtttgacacgtcatccaaactataataaaattttcaacattcttttaaaaaggtaatgttatggtatcatacatggttttacaaatttgaaacatgtttttataaaaggagaaacaaataaagaaatattttgaaggagaaaactgagcgaactttaagattcgatagtatagaatagctaagctggttagtggcacggaaaccaaagcagtgattaatttagtattaactttaataaagttaaaaaaatggatttatttgacttatgtataaagttcttataagcactgttaaaagagatcaagaagcttaggaaacatgctcacaataaatgaggaagtagcctagcaaatactcactctaacacattttaagcgcaactgtgagtttccatgtccaatgtttgaccgtccgttatatttgaaaaaaattatgaactttttttaaaagtaagtctactattcatgtcctatgaaaagtttaaataaaacggccggtcaaacatatatgcatatgtacataggaacagataacccatgcagcattttctagataacttaaccaccttgtaaacactgtgacagttcttaaaaaaatgtacactctgtgacactgacacgttattatacaactaagttatctcaacaaacttaaccgctataaaatgatgaatattacctcaagcatccaccttacatatttgacgttgttgacatgatggttcatatccaaatcgctgcgcttcggctacaaatataatgtgcatatataagaataagatattgtgatcctatcctgcgttaaattaattgcttcatatgagattgtgacaaactgaagaaaattgcagagcctctggagcctaggaatatagaaaggcaaatcaattaaattaataaagaaatattttttatcgagaaaattaataaaggaacttagtttgtgcagtagaaccaatataattaaccttcaagtcggaatcgacatatgtggcattggtgtcgagcttgatgatcttgtcggtggccacctcgtcaatcgcgtgcctgtcgatgaaccacggcgagatttcgtccctgacctccttcggcatcttcgacagcctcctggtgaccttattcatcatcacccatgtactgcacaaacgacgctagggataagaaaagcagttgactaactgagttactactagtaaagtataacaaaacaaaatgagttaattaatacccagggcatggtttcccttactgcggggttaccgcttaccaccgaggtgcgaaaaccgcctgtatatcaaccaagttcaaagaaaataccaataaatatttaaattttcggtaaattttgctcggtaaccctgttaatgctgttaatgccctatgttcgatgcttcgtggttgttgctatacaggcggggaaaattactgaaaattactttgcatgagcttaccgaaaatatgtttttaggcaaagtaatttaaccctgttaatgccctatgtttctagaaattgaaaaataaataaatagcaaaatcaaatgttaaaatggagaagaacaggtggtatgacgttggagagaccatgagtgcaagaattcacttcacaggttcaaaccctggtacttgagtactccctcccaaaaaaaagacaaccctggtttccgtgtccaacgtttgacaatccatcttatttaaaaaaaattatgaaaaaaattaaaaagacaaatcatgcataaagtattaatcatgttttatcatctaacaacaatgaaaacactaattataaaaaaatttcatataagacggacggtcaaacgttggacacggaaacccagggtttgtctttttttggaacggagggagtacatttttaataagaatcattgggtttaggtatttgatgtggtctccatcttttttaccagaacggatatatgattgcggtgtgtgtgcgcataatgctctacgagcgcatatctaccatgtaattgaataaccatatgtcaaattataagtagttgaaagtaaaacaaaattcaaagcaaaagttgagataaaaagtttatattttaatcctacaaattataattctaagagcttgtatgtaaatacaaagcatattattttagtaaagtcacgtgtaataatatccttcttaagctgatggtttttaccaccagctaactttactacatggcagctataacttatcaaataaatcttcaatccctaggttaaataataaagtaaactcagtataaaatgattacactctcaagccatgcatctagcgaaagcgtggctcacctaaaatcaagggcatctaaaaaaatcaggaaagggttttttataatggaataaatcctatcttttacgtccagtaagctatagccaattattataaaatccactcaataaagagcaaaaaaaattccaggaaacagtgcacaaactaatgatcaccaatagaaaaatcagaaaagggtaaaaacacaaaacactttggactttaatacttgttggtttttactttgaagtgctgagctttgatcaacactaatttaaacaatcaaattttgtagcatccaagttgtattattacatttttaatatatttaaatgtatctgttatgatgttatgtaaaaaataacgctaaaagtttatctactcacgatcaaccggtcaaatcaacaagtattcgtaagtcaatctaattgaatggtataaaaatcaatgaaaaagttgaggaatattttaagtcgaaacaatgttattggctaactgaaaaaatgaaaacacattaaaatattcacattaccctaaacagactactattagaaatggcgcgccaactggcacccatattttctagtataactaattattaagactggcggatgatctctagaagacatacctggttgctcggacgaagatggcgccggagctgcggccgcggacgagccagtcgcgccgcatgccgttcttccccgacgagcctacccacgtgtcgatctccagcacctctcccctgcaaccaacctctgtctgatgagcataaattttcttgccccggcctctctgaacgaacaggacgccatggacgaacacaaatactaatataatataccagatggggtagtggtcgacttggacgtgcatcctggagacgacccagatgaggttgttcgtgatcatggcgtgcgtggcgccgaagccgtcgccgaggaggcccgacatccacacgtggttgagcgccgtctcctggaggaggttgagcaccgtctcgagcgtcgccgtcctgtccggcccgacctcgtacgaccgcaccaccaccgtctgccggtaccgcacgcccccctccacgatcaccgcctgccggaacgggtccaccgtctgcttctcactcgggatgttctgccgctggctcctcctgccctcggcctcctcctccgtcggcggctgtgacagcaccggcggcctcatcagcccggccagcgacctgttgattttcgtctccagcgcagccccgacctggagcggcacgcggtgagccgcgccgttcaccctcacccggccgccgccgctaccatctttctcgtaggccgagcacctcacgagcaatttcgagtagtacaataatgtagtgttcgccatgcagatgcagtgatatatcgttcaaaacttttgcttgctttcggcgattaacggagaagaattagtagcagtttagattaattatatgctcaatggcgcgccgtacgttcttataggactaacacgattgcgcgcacgagcacgagggcggatccgccaacagagcctcgtttgtcactcgttccaacggacaaggaacaaagaaagcaaacatccttggactcaatcgcttgccatcgctacaaacaatgcaaacgaaaatagcctaacttggaccttacggagagcgaaattggaagccaaaatctggacaagagaggtgggctcctcttagtaataaataataatagtaataatgttacattctgatgccgcagtcatgcatcgactttgtgccttgttcttgtcatgacgagcactgacagcatagattctttggaattggaagacacttttattggagtaaacaaagcagacaattcattacttctaccaatcgaacattctctatatgctggtacaggcaagatgaatatccatttgtgactatagtcgtcggtaaacggtaacattaataacaaaacagaaactacatgacatgctgcatatggagcttaagcattcttatgccttccactattcaaactaggtagttttgggccaaaaaataaaggtaactgcgctgagttgtttatacggaactagttatcgtgcacgtgcaagacacgttttcgcaatatatatacatatgaaaatagaacaataaataaggtattttctatgcactgcactccatacaaattatacagataaaaatagagtttcatagaccatggtaggatgacaatttgtataggtctataaaaaaaacagcacagtgtatttctagagtgccaatataagatgcagtgcactgctggagaagcaaaccttgtgtttcttgctccaagactttggatctaattccagataattcatttagcataggaaaaattccagagaaattatatttgaattgacatctttaataatagcacagtggctaccgtcatacaatctgatctttttatacataatttaaaatacttttatatgattcctgaaatgtgaacaccaaaatagattataaggcagtgctttgttgtacttgaagcctaaactacaacaaattgatctctcccttcacttgcagccatatctctatacatttgtgcacgcctgagtgcaatgaaaatggatttagtggtgatggtgatttttcttctattaagacaactattggtctccccaatcatcaaagcccaagttgtcatgatgttacagagttatagaatgcgagtgatgaattgaattaataacgatcagacagttgctaagattccagtgcatgtcactgggtaggccaaggggatttggtgtgtatcacctgttcatgcaaatggatttggtgtagagcttccaacgatattgtccactgcaataggccaaggggcacagatcaatggccatcacaggttatctcgggctctatcaggtgttcatatcaagggcacaactcatgtgcatgatcaaattatcatgtagactacgaaaataaatgcctcaccagctatagaatctatcaaaatgcttgtttacctgcaagaaagtttactaaattatttaaaagtttgaagtgaatcttacttccatattctactacatagaaacaaattgcaaggaagaaattcatattacaatcttctcattttggtttctgcctccattaacagaaattcaaaagctctatatgaatgccctataggacaacaggacactacacataaatatgtcatcagtttctcatattcttatttgtagaactgcattatagagactcagagaggaatacaatagcccatggttagcataaatctcatggaggtagacctcaaagagatcaaaatagcagaactttagtgactcatatgagcaagtaacttcaagatttcattaatcaagtactgtacaaatctttaaattgaatggtattgctaattgacacggataatgtatgtgctggtgacaactcaattagattttggcgatgtttcccatattttcagctattgacagaataaagtagatatgtgaatatctgaaaatatgcaattctgttacatatatttggttattgtacatatgttttcagcaattaagatgtgacattttggtactgatacatatattttcagcaaatattttccaggaaagctgatcaccgaaattagttgtaacaataaatgaatgtcagtcaattctgaatatgtgaaagcaaatggcttggaagatgccaagggctaaaacctgaatggtttagtcagaacctgtctaggatacagccctagcaacatccagagattgaaaagctaataatagtttgttgtagtactaatgcgtacatttcatttgatcgagttagtgtgaacacctaccagagtgcgaactggaatcaacaaataccgtttccattgtcttgggaagagttcacattacacaaatatgatgcccctcgagaccactaagaatttcgatactacaatatggtgaatacaacggcaaccagagattactatagtgataacattttgactaaatggtacactcgaattagtatagataaaaagaacattcattttggtttatacaattctaattattaaaaaagccacggaaaggtgctcataggccacacaaggatcatagaaatagtgtcaatccagtgtcaaaaggaacacatgaaatttagtataaatcattaactgtatcagaaaataaaaacgatcagaattcttggtctttcatggtagtattacaagtaccaatgagtaagtagcagtaaattgaatcattttatcaagcagtaggggagcatgggcagaaatcaatgtacctgctgttgtcttcctcgacgctgccccatgctccgccgccgtcttccttcttccaatactcctcattctaattccatgtaaatgcaatgctaaaatatagagaaaatcccctgtgtgcccatgaaaactcacctaatcccttctatacccccgaattttatccaaaactcacctaatcccttctatacccccgaattttatccaatcccctgtgtacccctgaaatttcgctgtgatcccttccatgcccctcccgttaggtttccttcattttcacgttatgtgtggttccaaatgtctaaaatccccttgtagatgtaggagtggcagctagattgaaaaaattgaaaaaatgttaactgaacaatatgtgtattttatgagactaaataatgagcgtataacaaatttattgtggcactgaaaaaaatgcaatataatgaactttttgtttggaaaaataatagatcaggaaaagctgactgtctgtacagtcatcagttttctctatagaagaaattggttcctctgtacaagaaattgattatggtaaaataagagcatcaatagcatcatatataataatagagatattcatacagaacacacaatatcatgcacagaacataatctttccatcatccatacataacagttcatatcatgcgcacccacaatttcatttccatacccaatagtgcaggaaccaaaccaactttccatttcaaacaaaatggtgcaaccaacaaaccaaattagctacgcaatatatcatgagcataatggcataaggtccataacagtgcatcattacatcatgaggaagcaatccttacaatagcaaaatatgtcaactatgactagaccactttgcagggcatcacaacaacaaaatccatcagcctccacaagagaaatggacagtaccaaaataaaacctaattagcaagccatatgattcagtccataagttttcttttgctcctagtgcccattgcaggactcttatttttgctccttgtgctcatagctgggctaccaggagtactagaacatgatgactttccctttgtcttgctcttggtcatttttggtgcaactgtaggtgtttcctcccccagacatggcaaggctacaatcatgttagatggctcaggttggttggagccagtaagtgatcttgatctgaaaaagagaattgtgaatatattgcatagaacaacataataccagcaaattgacataattgatctaattacttacctaattgatatacttgaacctgagctattgttcaatgtcctattgtcctcggtgaaattaaagttttgactgtgaaaaataaattgttatgtaactaattgatctaaatccaatgtagaatgaaataaagaagataggctaacctaggagggtatgccattattggtgtaactattggagcagccatgatactagtctctgaggttgcttcattagttttcttcgttctcttctttggtggccctctatgaacaagagaaaatatatgtcataaggcttgttagaaatagaatggaaatttgtgagacaaatatacacaagtgtttaggttattaaatcgaaccaccgcattactttctaatcttatccattaattataatgtttagtactacaaggatggaatgtcatgaaatatatttatcaacttacacagctgcctaaattgcaaccaccaactaaaatgaataaaagacttgcaatgatatgtacctttcagcaagcattgctgctacttcctctggatcaccctctttgcaattgtgccaatgatggccataactcttgcaaattgggcatttgtgcctcctactccttttgcttcctttctcagtccatcctttgtacctcatagttcttggtctcccagctgatttcttcagaatgggtggtgccaagaaaaacccatgatcagcttttggccattgtgccttgtcaggtaatgaagggatcaatttctcatatgctgccctgaatcgatgcacactaaagcaatcatccacataatctgcaagccttcctctaattgatgtgatgaatgctatagcatggatacaaggcttccctgagatctggaattccctacatgtacatgttttgtgctccaaattcacaacatgtctaaacccactacctcccttgacctcaatttctgcctcaaagtctccattccttgtgaccaccatgtctaaatctctacttttttcattcaattccttgacaatatgaggtagaatgcagccttcgaatttctttcctattctttgcctcttatcccatttcaccaacaaccaccgccgaatcctctccaagaagtcatataaatgtagtgctttccaatctttcaccaagttgttgaagctttctgcaaggttatttgtcacataatcaaccttgcaaattgtacagaactgactcctactccatagccttttgtgatacttcttaaggtatgctactgcttctggtttaacttcttgtatggctgccatatgtttctcatagaagtatgggctccatgcatatgacaatatacttaaagaatgcatgctgatttaaattaaaaacataccatcatagtgacaccatcagcaaccacggatgcatgaatcctccatttgcagcctttagcagcacaacttgcagtaaattgccctggttcacttcggatgatgttatattcaaactccttttttattgcatgttgtgctattgccaatctaaattcattaatgtttggatatacgctgcctacgatcattggtgggtcatttttgtcataagttgcaataggaatatgttcaggcatcccatctgatgccattgactcatcctcggattcattgacaccatcatcctcagatgcatcctcagattcatcctcagatgtagcccaagattcatcctcggatacttcattgacagccccttcatctctagtttcatcagcatgaccaacaacagcctcctcctcatctaagtatatgccttcctcatcaacaccaacatgctcagccataggaaatgagtttactaagtatgtgtctgatggcacaatgacatgagaaggaagagtgctgctgctaggttggctgaaatccacttgagatggggttgccaaagaaggagtatcgggaacacatgcgcttgctttaacaagagtgtggtctaactcatcaatactttcattaataccatgtatgcgaataatcattggaatcaccttgatatcaacaaacttttcaaacattgtaagcatatcctggtcagttgtgacatgatgagtaattttatgaaccatatccacgtagccaattgtgacagtttcatttggcccccatggatatgacttcgcaatatcatcaataaagtctttgtagcacatcgcatttgagtctatcactttactgaaaataaaccaatcatattccaccctagcattttttcgatccctggctagtttgatttccaacaaatatgtagttaaggggtccatcctgtggatgaacacaatagtatgtatctatcaatgtatgtatctatcaaccaaaatgatccccacgcatacaactacgtcaaaattatgaacgacggaaagttaagtcacttaccctacggggagccatgaaggaaccgtgctaagcattgaatctgccatgccaagttgatgtggtgcagagaagggatggtggcctccactgctccgctttcacttccttactttttgatcacctttgctagtcaaaacataagtaataatgaaaccaaagtgtgggcataatgattaaatacaaccaaagtgtgggcataatgattaagctttgttgagtcaatcaagcatatggaaaattttgtaaagtctccactagacaaatactagtacactggacaaatattagtagagttctcatactaataaggcagaaagaatgatgtaatgcatttatgtgcatggtgagatcttggaacttatagatcagttttttctaatcaaaccccttatccttccaagggcatttccaatggcaagaaagtagacctaggttatatgcaaaaaca

SEQ ID NO: 69571 - DNA, 27739 bp, Oryza sativa
acggctcgcgtggcgggagggcggcgggacaacggctcagcggcctgagggtggtgggacggcggtgcaggactgcaggccggcggcgcacagaggccgctcgcgtggagagatgcgagagaaggaaaggggatcgaaactagttagggttggcaggggcattttggtatttcctaaaaatactgacaatacaacacatggtttgattaacatctctaacggaaacctgacgggaggggcatgggagggatcacaacgaaatttcaggggtacacaggggattgggtaaattacggggtatagaagggattaggtgtgttttcatgggcacacaagggattttctctaaaatatatataaacctgactccatgtatgcaaacaaaaattagcacctgcaatttagttatcatgacacatcagctgctatacgtccgactagcgcgttcgactggcgtacgactcaacggcgaattacacggcgtgaggcagtactgacttggtcagatgggctgctgctccaactgtcccacgtaacataatccacatcaaagcccatatattatttcaagcctgaacttataaggacacaacatgtccttttagccgcacaacgatattttgtctcatgtctatgattttttagataaaaatttggagtaggcataaataaatcagcagctttcacatactttttttttcggggaagcagctttcacataccttgtgtgatgtgatcagtgaatactattggctagataaaacaacgtggccgtgtggccaaattacatcttattgaactcaagaaattgattagagatggaacacaaaggaattagatcgtggggtttaggatagaaggagatggaaagtcacgttgaggcaatattatcggctagatgaaacgatgaccggaagtgcggccagattattgaattgggcttttgtaaggcccaactgaattagtgatctatgcggatgtgtagacacggacggcggacgtcttagtcgtacaagggtcggatgctttggttgtatgtatagcatttttggttaacaatatagtgaaatggactaaaatatagttagtttcaaactgttaatgctacaaagccatgggagaactaaaacgtgatgaaaggtcatcagaacagccaattaggggcggtttagatggggtaaaattgtttagtccctatcgcatcggttgtttggacactaatttggagtattaaatatagactaataattaataaaaaaactaatttcataaataagagctaatccgcgagacgaattttttaagcctaattaatccataattatcaaaagtttactgtagcatcacattgtcaaatcatgacgtaattaggctcaaaagattcgtctcacgaattagtctaaggttatggaatgggtttttgtaattagtctatgtttaatactctaaattagtgtccaaacatcctatgtgacagggacttagaataagtcgttgtttcccaaacagcctgtaataaagctaaatctacattttggtgcatggcagggaggagggagctcggctctacgtacggctcagctcaaacgacctcggctctacgacacatgcgcgcgcgaggagggagctgtggcagggtatggcgagcggtagagaaggtgtcggccgacgtgacccaagctctccggtgggcgcacgcgaggaggctgtgccccggccgacagcgaccccggctctctaatgggcgcacacgaggaagcgaggaggagcgaggaggtggtggggattcgcagggcggattcattgcggcggagtcatcgcttggggcggaatcggcagaatcactgatgaatgcgtactgcgagaaggacagtggacggatgagattagatgagacggtagatggacggatgagataagaggggatgatttcacctgtaggatttctaggcacaactcctccttttttatattagtatagattgtgctgatcttgtttattttttcttccggcatggactcgtatatccctagtggagaactgatctactcccgtgctacccaaaatcataattgtcccagttagattaagaactggtactaaagatgctccaagtccctcgaaatatttttagtctaggttggtgttatcaaccgggactaaaaaaaataatctttagtcccggttggtaacactaacacggactaaagatggaggatctttagtcctagttggtaactgatcaggacatcactccttcgaatatacacaacaatcctctaccggtcattcaaggagcaatcacaagagctcgctcctatgtccttctttatataattttgagaatagattgctatctaatgattatgattatattacaattaggaacaatggagaggacaaagagatatttagagagggacttagaggcgtggaggaccagcaagggcgtccaagtcaagatggaggtccaaatctagttgacttcgagtacgtttcaaagtccatgaccaatctgtactaaaacgggcgcccaggtcacatacgtgctcggattggggtgttctttatatggatggaaagctaagaagataacatttccaatggttccaatcccatatccaaattctttccgagtcatcgggaatcgaccgaacaagttgacttccaaattttgttccggtgctgtgtcaccgtattttggcctttgggccgtgtatcgtgttggagcccattagggttgcgtatgttagattaatgggctagacccaattaaatcctaataaattccattggtccacattaagtgctatgggtaataataccaccttggaaatctaagtgaagaggtctcaacttaaatatggagctagtggagagtctctgttgaccggttgagatggtgggcgaacagcaacacgcgcgcgccgggccgtggcgtgggcgtgggtgagacaaggctgctttctctctcgttttgtgtcacgtcccaaaacgactctaaaatacatcctctaaattatgcctagaataattaaaatccgtgtgaaagcctccaacaattaaaaggtgcaaagttaaaagtcaaataaggcttgggggatttttgtatatttcctaaaatgcgtaaataaattttagtggaattttcagagcacaaataataattattaagaaataaacaaagttaaaatgattttgtaaaaggaaaaactctaaaaagtcccatttccctccctctccctcttgggccggctcggcccatctccctccccctctctcctcttccccgcggcccatccggcctctccccgcgcgcgccgctaacgggcgggcccgcccgccaccctcgctgacgggtggggcccacccgtcatccccttcctcccgccgctcccgccgcctcccccgcgccctagcgctgccgccgccgcggattccgccgcatcccgccgtcgcgcgtgcaataaagtgggaagaatcacttgccgtgatcccctctccctttccccccaaatttccctcccctctcccgtggattcgtttggaaaacctcccctaatcccgccggccccattgatggagcccgagaacgccgcgccggtttccttcccctccggccgccctctcccccttccaaccctatttaaaccctccccgcacctcctccgtccgtttccgcctctcgccaccctttctcctcgccggattcgagcttgcgacgtcgctctctctctccgccgtcgccgccaagctccggtccgccgccgtcgtcgccccggaccgcctcccacctcggtgacacctccttcgggttcgccgcatcctcgccaacctcgtccacctccccgtttcggtcgccgaccgccggaacgccgtcgaccccgtcgacccgagccgcgctgccgcctccctccgctccggccgcctcctccgtcgccgccgtcgccccggggtgagccgtggaccgtcgcctcctttcccccttccctcccctctctcggccgccgctccgccgcgccggtggtcgccggcggcgaccatcggggcgtgggcgcgccgcctcccgccgactgcgccggcatggccgccctccgggcgcgccgagtggccgccgcgtggggcccggccgtcagccgcccgcgccctcgggtgcggctgacgtgtggggcccacggcgccggccggtgcgagcccgggtgcacccggtccaccgtggaccgtgaggctgccgcgtgggccccactcccgtggacccagtccgcgcgcccctccccctcggctgacgcaaataaaccctttttaaattaaaatttaaatggagaaattcgcaaatattcatttaaagagcatataaacttcaaatggccataacttggccatttgaactcggaattggaccattcaagtctctaatttttccttaagaagtcaagaacccatttttgcgctttgttcctgcttgttatatggagtttattagagtaaaagccttttcttttccgttggtcgtgtagacgctgcagcttcggaagatccgctcttcgtggaagttgaagccgacgtttggcaaagagagcaaggcaagtcacatcatccttgaacatattgaatcccagtttataaaattattttgatttaaattattgcattatcgctttatttaaattcccgcgttatcactgttttatctagccatgcctatgtacctttgttatgaccttattattgttattgttattattaccttgtccaccctagaataaacaaaacaccaactagtggacactctactcatggtaccactagtatgattttaggtagatgcttcgctggttaattaggcaacattaggtggttttacaactctagactttgggatattctcatcacctggacactatggaattgttggatcagtgtggaattggattcacacctccccctctattcaaaatcctcaaaatggatttaggttgggctcggggtgcatggttttgatagtagcacctcggccatataaggaccggtcttcgggcctctgttgcaaagcactaccgtacttccacatgtttagtgggtaaggcttagtttgtggctcagtctggttataaacaaaagtacacggatggagatggacgaagtcgggggtcgatggacatctctagggcaaatgaaggctacacgagctgcggctcggtagtcgagatgtcatggcacagggccggtgtcctgctgctaggggctcagtcctgcctacctgtcccggaggttccggccgtaggtggggttgggtctgtactcttgtctatggctaggatgggttggaaactatgtcacgtcttccgtccgtataccgtggtggtatgtggcacgtgtgatgaaccctgagttcctctcgacactcaaggctgttgttggcccgatctttcggtgagttgtgatatctacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatggaccccacctgggccggggtcccaaatgaagttacaagcccataggcccattataggtgatgcaacaccttgttcctgtgattctggccacacgagatagaattcagagaagaggctggatccgttaaaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaacgtggttacatgtgaggaagatgtgtcttgtgggtaaagatgtacacatctgatcagagtataatctattcgaatagccgcgccctcggttatgggcaagccgagcaatgtacccaagttagtgtttttaattcttaaaacctgcttaacaactaaaatgtggaatggttggcctgggttggcttgggacgagctgggacccagggtcgggttgccagttcagtctgaatcatcgtaggccttgggttaaggcaggttcgtgtgggttcacggccttgattaataatattgtatagctctaggatcgtatttacaaaatagctttgagcaactaagtgtcttttaatgctgtttgctgcaaaccctaaccctttatattataacccccttgtactcccttggatttatcctgcacttgtgagtgtgtcttgttgagtacggtggttgtactcagtcttgctcaattttttcccaaacccagaagaggagcccctggataatgaaggctttggtgtctagctcgtgcctgccgtcaagcgcctgtggtcgtcgccctagtcttccgctgtttttcgtttgtctttttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttctggtcgtgacattttgtaacgaacaataataaatatgggaattgatttagtatgagcgagcgcgtcggttacagaattaaacaccgtggttgatgatcccgaacattactctcgcgctcgcacatactctctcgttttgtaacggacaataataaatacgggaattgatttcgtatgagcgagcgcatcggttacagaatttaacaccacggttgatgatcccgaacattactctcgcgctcgcatgtagttcgtctcttgcacttatgttcattgtggagattatggataccccatatctgcatgacagttatactttagtcggatatacggcaccaaatatagatggaatatctttatgagaactcgggttggtttttaacttgtatgtcaagaaaatatccgggatcctagtcggttacgattgtattttatctataatcccatattctgttaggatatggactgtattttgtaaagcggactccttcccctatataaggagggtccgtgtgcctcttggggcgcgattctttttccagtttatacaatcaataacacactcggcggaatcatccccggacaggagtagggtattacttcttgaataagaaggcctgaacctgtataaaatcccttgtctccaaacccatccactttcctagcttgatagccaccccttttattattgccgaaatcttgtttcaacagttggcgtgccaggtaggggtagcgtcaagttctcgccgactaagtgcgatgggctttgtttctggcatcgacgacttcgccttccctctcgggcaggcgttccggttcggcagcctcaacttcatcaccaacgacttcggcaagatctctctccttgactcggattcaaaccagtcggggagagaccaggtccccgtgccattcggtattccgaactcggcctactctaagatcatctctcccgagtcggcttcaaaccacttggacgagatccaatccgctcggcctcgtccagatcaagacgacgggtcctatccctcaatcttgatgaaacttcctgatgatttggccgccgtcttcactgccaagacatctcccactcgaagatctaggcgagctccggcttcggccccgatccaatctagatccagggaggttggcgttatactccaacctctcgggacagtctcgacggaagagttggatggctacctcagctcccccggcgtcagttctcgaccaaccgagatcctcgactacgacgatttcggctaccactacgaccacggcgacctcgacaacttcgacgacagctatgaggataactacacgcccctcttcttcggcgtattcatggctgacaacgaaacggaggaacagcgccaagcccgagaagcggaccaagatcgcgcacggcaagaagctgaacgtcgccgactggaggaagagcgacagcgacaggagcgagaacgactacagcgtgagcaacaagatcacgaacagattgcaaaggaggctgaagatcgacgacaacgcgccttggaatctgggcggcgagcgagagagctcattgggcaacaagacgtcgatggaacagcggtctttcacaccccccagcagaacgcggttgcagcaatcactctcctcgacaccctcctcaaggaagacgcactcaaccaagctgatcatgttgtcaacatcttgaaccagatgaagaccatgatcgctgcctcggttccagccaactccgcaagcacccgcactccgactggtagccgagtccctcatctccgatctcatgattatcatcagccaagcctcagcatcatcggcacaggatctagccgcaggagcaggggtcacgacgaacgatctgttcactcgcctcccgaacgtcacagggagcgccgagtcgaacggcctcgctctccacttcaccagcgtcctgtcgaccttcgcgacatgatcaaccagcgccgtgcagcacgaggtcaccgccattcaccaaatctctacgacgacgacgtggatggagtagctgccttcactaatgacctgcgtcgagtggattggccagccggctttaagccgactggaatcgagaagtatgacggcaccactaatccggagtcttggctcaccgtctacggactcgcaatccacgcagcaggaggagacagcaaggccatggcaaactatctacctgtggccctagcggattccgcccgatcctggctccacggactaccccttggcatgatcggatcatgggcggaacttcgtgatcacttcatcgccaacttccagggcacctttgaacgccccggcacacagtttgatctctacaacgttgtttagaagtctggagaatcccttcgagattacatctaacgcttctccgaacaacgcaacaagatctccgacatcaccgacgacgtcatcatcgccgccttcactaaaggcattcgccacgaggacctagtcggcaagttcggacgtaaacctcccaggtcggttaagcagatgttcgaaaaagccaacgagtatgtcaaagccgaagatgctattaccgcgtccaaacagtcgggcaccacttgaaagccaaagaaggatacgccgaccgcaggagagagtggaagtaacaaccacaaggatcgcaagcgtaagcccgaagaacttgtggcgaccacctctccatcttcctgacaacgttcccgcatcaacaccttcgacaagataatgaactcccaatgtccgcatcatcccaactccaaccacatggccaaagattgcttcgtctacaaccactttggagcaatacgtcaagaacgcacgtaaaccttcagacggagatcaaggcacatcaaagaagaaagatgatgaagacgatgccccgactggttttcaagatcatcgcaaataacttaatcacatcttcggtggacccctggcttatgagtctaagagaaaacagaagctaacataatgggagatcaatgcggtttagcctaacacgccccaatatcttcggtagttagaaatagcaattaagtttgaccgctcggatcatcccgaccgagtgatccacccggggcggtaccccctagtactagacccagtggttcgcaatgtcaagctccgacagactctcatcgatggtggcagcgcactcaacatcctttttgctaagaccctggactatatgcagattcctcgcacggaattgaagccgagtaatgcacccttccacggtgttatcccaggattgtcagctacaccactcagccaaatcactcttccagttaccttcggcactcgggagaattttctcacagaaaatgtttgtttcgaagttgttgatttcgagacagcatatcatgctatacttggacgaccggctttagctaaatttatggtcgtcccacactacacctacatgatgatgaagatgcctggtcctcgaggagtcatatcactacggagcgacatcaagcaggccgtcacatgtgacaaagaaagttgcgagatggcccaaacccacgagactactctcacccgcgaagagatccgactggctgcgaccacggcaagcgagggagaagtgcctgcaaccaagctgacgaagaccgaagaacgtgatgctaagacgaaaaagattcccttagatccctccgatcctgataagactactgtaataggcgctgagttaaattgtaaataggaaagcgcgctcatcacctttcttcagaataataaagatatttttgcatggaaaccatccgatatgcctggtatccccagagaggtgattgagcactctttacatgttaggaagacgccaaacccatcaagcaacgactccgccattttgcacaggacaggaaggatgcgatcaaggaggaattaaccaagctgttagcaacaggcttcattaaggaagtccttcatctcgactggctggctaacccagtcctggttcgaaaaaagacggggcaatggcacatgtgtgtcgattataccgacctcaacaaatcttgtcccaaagacccttttgggttacctcgcattgaccaggtggttgactcaacggccggctgcgagttactcagcttcttggactattactcgggatatcatcagatccgactaaaagaatccgactgcttgaagacctcgtttattacgccctttggggcctactgctacatcaccatgccctttggattaaagaacgcaggagcaacctatcaacgcatgattcaaagatgtttttcaactcagatcggtcgcaatgttgaagcttatgttgatgatgtagtcgtcaagaccaagcaaaaggatgacctgattgcagatttagaagaaacttttacaagcattcgtgctttcaagatgaaactaaacccggaaaagtgcatcttcggagtaccgtcagggaagttgcttagatttatggtatctcaaagaggcatacaggccaacccggaaaaaaatcaacgccatcctcaacatgaaaccgccaagctcccaaaaagacgtccaaaagctgattggttgcatggcggcgctcagccggttcgtctcacgactcggcgagcgggggatgcccttcttcaagctgctgaagaagactggcaatttccagtggggactcaaagcacagaaagcctttgaagacttcaagaaacttctcaccactccaccagttttggcctcgccacatccacaagagccgctactgttatatgtgtcggcgacctcccaggttgtgagtacggtcctggttgtcgagcgtgaagaggaaggccatattcaaaaagtccaacgtccaatttattttgttagcgaagttttagccgactccaagacaagatatcctcaggttcaaaagttattatatggtgtcttaattaccgttaggaaattatctcactactttcaaagtaactcggtcacggtggtcacatcgtttccactcggagatatacttcacaatcgcgaagcaaatggacggattgcgaagtgggccttagagttgatgtctttggacatatcgttcaagccacgaacttcgatcaagtcacaagctttagctgatttccttgccgagtggaccgagtgccaagaagacatgccagaggaaaagatggaatattggactatgcattttgatgggtcgaagaggcttacaggcactggggctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttggttgttaatcaagtcatgaaagagtggtcatgtctagatgataatatgaccgcttatcgacaagaggtatgcaggttggaaaataaattcgatggactcgagctcacccatgtcctccgatataacaatgaggcagccgacagactggccaattttggttcaaaacgggaagcagctccttcagatgtgttcgtcgaacatctttacgaaccgaccatgcccagaaaagagacagtcgaagccatggatacccaaggcgtaagcatgatcgaagctgactggagagaaccgtttataaaatttttgagcaaacaagaactccctcaagacaaaaatgaggccgagcggatttccaggcgcagcagactttacattatccatgagactgagctgtacaagaaaagtccatcaggaatactgcagcgctgtgtgtctttggaagaagggagacagttgttgaaggatatacattctggtatttgtggtaatcatgctgctacacggaccattgtcggcaaagcttaccggcaaggttttttctggcctatagctgtgtccgatgcggacaagattgtgcggacatgcgaaggttgtcaattttttgccagacaaactcatttgccagcccaagagttgcaaaccatcccgttgtcctggccgtttgcggtctgggggcttgacatggtcggcccgtttaaaagggcagtcggcggttacacgcatctctttgtggctatcgacaaattctccaagtggattgaggctaaaccggtcatcacgatcacagcagataaagctagagatttcttcatcaacattgtgcatcggtttggggtacctcatcggatcatcactgataatggcactcaattcactggcggagcatttaaagacttttgtgaagacttcggcattaaaatttgttacgcctccgtggcacaccctatgagtaacggacaagtcgagcgcgctaacggcatgatactccaagggatcaaagcatgagtttttgaccgactacgtccctatgctggcaagtgggtagatcagctgccgtccgtactttggtctttacgcactactcctagttgggctaccggccagtcgtcgttctttttggtttatggcgcagaagcaatgttgccgagtgaagtggaatttgaatcactacgattttggaacttcaacgaggagggctatgaagagggccgagtagacgacatcaatcgactagaaaaagcccgagaagcagctttaattcagtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagtcactcggccgggttcttatcgactcaagggcggagacggtactctcatcaacaattcttggaatattgaacaccttcgtcgattttatgcttaggcatttcgtttgtatctttcctctttgactactaacttcaagtttttccttgaagttttcagtcagggggctactatgataataatggagtgtgatttttatcaattcaatttgcttacttgatttatcattgccatgtttggtctttcgacttagccaatgaggactaaaggtttttaatagcttttgcgggttttaggctcaataagacttgacaaaggcttttaagaaatcagaagctaagtatggaacaccaagcatagcataaattcatcagtattgtacaaattgagcctccaccgtcattgatcatcaaaatcattgttatatcaataagtatcagttttttcatcatcagacttatcagacccagtcagccgaaggtcgatatcttggaatctctcaactacatcagcagcaatcttgtcagcggctttctgcgcatcactgatgaggtcaagagcagcttcttcgctcgtcccgtttgcaaagccatcaatggcatccatatcaacccttggataaagggatttggtcatcgccaacgccagacttgctcccatacttccagcttctttgatgttcttgaaataagtatctggagcgactctcagcttgtcaaagatttcggtagcatcaagtgtactcgaaccggcgttattgaagaacatggcctggatgagtggagtagcggcattagcgactttatccctggctccttcaagcttgttgatcttgtcaactaagacatcaaactgtgcttgagacttgatcttgcggtctccatcaacagattcacattaatgaatcagcatatagaagataatggcttttgaagtattgattattggtaccttcaacctcttttaaaaccgaatccctctgtcttgccagctcagccttgtcattttccagagtttggatctgcttctctagttgagatatcttggcagcttgcactgcattaacttcggttaatcaagattacagagataatagcacaaatcagttgggcagagtttgcgcgaacctagccactcagttcgaaattggactcctggagctcagcaatccgatccctcagatcgtgttcattcttcttggcaagttctctggcctcgtgcagttgactcctggtggcttcgagggttccaagatgaggaactagtctctctagggttgcagttttcgcctcgttcctaagatgaatcctctgcggagcagtttaatcagcgctcgcgccagatggcaaacaagatggctgaggtcaggcgtcaaggaacttacatttacaatgcgagtcgcttggttgagtgcctttttcagtaggcagacctcttcgtcttctttttgccggtttattacaattccttgaggttgcaagttgtcatcccaccacttgaccagaatgggagggcacgaatcttcggctgctcgtatacgggggatttcttcttcatcaccaatcattggtcctaatgtattcactgacaaaggttagacaattgatcagagttatttgggtcaacatggtttcagataaagtgtttacccgtaatgatttctggacgaggacgagtggatttggatgcctttaaaggagatctagatctctagttattgctggcgttttgtccgcgcgggctgtctgcttgggtttcgacttctggaatctcttggcttggccttgcgtccgactggtttccagtcgggggctcctgattaactccggcttcggcttcggccgactggtttccagttgggggttgatcaccggattctacattatcggttgccggctgattgtcactcagatgatccccagcagttggcccggtttctttggacgaacttgtgttcatgttagtcgggtcagagtctttcccagacggatccatatcaaatggtttcctgcaaatttaattatcagtattattgccgcaatgggtgcgcatcaatacaagagagatcgttatatgagttgcacctagaagacttcctgatctttggcacagggcgattggatgttttcttccttggagtagcctgttttggtagtttcttggttgtctctcggtcttcaggcctcctggtggtatcatcggcttcgtcgtcacttaaaaccagcttcctctttcgataatcggactggccgactagatcagaagcacttggttgagtttcagaccgaattcttggtcctccgctcccttgcccagtttggtgacggggagatcggcgttgagcgattgggggatccgacttcatcaaagcaaattcctgggtgtaatatccttcattgttaactgattcaacaagaaaacaagatcatattttgagaaaggttgaagtgtatgaatatgtaccggtggaggaggattgaatgcattgaatggtacgactggcagcaagtgtgagtagctgacaacgatggcgtttgagaagatcttatacatcctttccttcatgaccttgaagtcaagagaatctggatcttcacggtttgggtcatgcttgccgtcaaattcgaaggctgtgcgagatctttctttgattggagctaaccgacattggataaagtgccgggtgatctgttctccttgaaggccctgttctttcagctttatcatcctctccatcagttctactgcttgtgcagcttcgtctcccattggcagtgagttccaagtatcccgataaactggaggaagacaggagtactcgggaagaacaggcttggggttttgaacataaaaccagtttgcgtgctagcctttatttgaggtcttgaagggcatggagaagtatttttggcttagtgttcccctgagttggaaaccagcacccccaatgatgcatggtttgatcttatttggctagggcttgaggaagaagatgcggcggaacaaggcgaaatgaggcctaatgcccagaaaagcttcgcaggcatgaataaaattggcaatatgcactatggagtttggattcagatgatgcaagctaatcccgtagaaattcagaatgccccggaaaaatcttgaggttggaagagaaaatccgccatagaagaaatgagcaaataccatgatttcgtgtgtatcgggggtcaggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaactggatggtttgatttagtttgagatacggctggaaagggatggggaatcggagcgatggatgcggggagaaatttcgtgaagtttttgagggtggatttgagcggattgatgaaccctagtttgcccggcgcagttttgcactgtagcaggaaatggggaaaatggcgagagtctcggcggggaagacgaagagacgtttttcacttcggtattattagggtatcgggagtactaatgggcctgggcctgtatagtatttcagcccaatactataatcagcgtggcctgttgtgatccctagggacttaggcactttttgctttggtaatttatgttcacaatggtgtggcctaatgctgttaaaatcctttttaacgcgatttaataattctttggaattattatgatgcacataaaaaggtgcccgacagaaaggtgttataccattttttgtaagctttattaggctggaaaagctgattgggttgatttgagatgactggtttattaatagtcattcttttagcatgttatatgcttattttggttatggtaagggtcacagcctaggctattagactcattaattaccatgattttctatcatgtttggtgggtcattctatgagatttttactcggattcctatcaaacatgtctatttttggacctttgagtgtttatcgctcggcccttcttgtattttttgtccttgatatgttcaagttgagcagcagtcagctgggtatcgtactaagtaccatgcatgcttcgctataaaactactcggttcttgactatatgtttagtttttcaactaatcacatagtcgggggctacacctaattaggtgcatctactcgatgcaccatgttttattttcgcccttcacagtttttgatttctagtactcggcaagctggagcaagttgaattgaagcactcggactactgttttttgtttcgagaaggttatttcgtcaactgcgaaggtctcgggggctactgtggagattatggataccccatatctgcatgacagttatactttagtcgaatatacggtaccaaatatagatggaatatctttatgaggactcgggttggtttttaacttgtatatcaaggaaatacccgggatcctagtcggttacgattgtattttatctataatcccatattctgttaggatatggactgtattttgtaaagcggactccttcccctatataaggagggtccgtgtgcctcttggggcgcgattctttttccagtttatacaatcaataacacactcggcggaatcatccccggacaggagtagggtattacttcttgaataagaaggcctgaacctgtataaaatcccttgtctccaaacccatccactttcctagcttgatagccactcccttttattattgccgaaatcttgtttcgacattcctccttcggccttgaacgttactctcgcgctcgcatatactccgtcaaaggagcgaacaaaagtacgacaagttcttcagttcttcccgtctcttgcacttctgtgcatatactccgccaaaggagcaaacagaagtacaataagttcttcagttcttcctgtctcttgcacttctgttccacctccggcctctgttcctacgctgcaagattcttcctcggttccgttcacctgtgtgcacaggtgtacgggattcttccccgtttccattcatcggcgcgcacagttgtacgggacgagcaggtgccttcggaactccgttcgcttgagaacctgcacgggtaggcgagagatcaagtttttggggagcgctacacgcgattgctcctgttcgtcttcctctgcatcgtctttgccaacatgtcgaacaccggcgataacatcaacactggagccaaggagaaggaggctcccgtcaacaccaacggaagcaatactgcctcaaactctagcggagggccattctcggggtataacgttttactactattgttcgttcttcgtttcctgctagtgacagccacaatgtcattgcgttgtcttgtttatgttgacgcttattttatattaagcatactcatgttgtatacatttagcactgtcactagatccacttatattgcaaagtcatgtttattgtcttaatattttggattaaaatatgccaaattatgaccaaatttccaacagcgtcaaggggtgtttgcatgaccctaaacttcatatattagtagctgccaccacttttagggtttgggttttgcttagattaatctgtcagaacagattcgtcgatccttcggtttgtgagagccccaacttgtgagtttaatcattcatatataatttggttgtattcgtttttgttcttgtttgtgttcttcgattcgcaagcagggattagccttctcggtgaggtcaaccgggtttcgacacggttgataaccaaaggagacgtggtgctgcgattgcggggcttaagagcgtgtttgtttagaagttggatcgacttgtgtcgcgactccaccaaatcgactgtttatcagaacctttcggaagatcgggaacccttgtccacatcaataacaccaacccggactaaaaaatcgatctttagttctggttggtaacaccaacccgaactaaagatgcctctaagattagttcataaggaaagcatctatattctagtcagatgtgtgtagtaggtgtgatggttacacgcgtgagtgctaaggtgaaagatcataattatcctttcttactacataaacacactgttgtgttcggcatttgagcaagaacaatagtaggctacaagtctgctataagcatgtgtggaatagataagagaggatagagaaggaaatcaactataagcatgtgtggaagagataagagaggatagagaaggaaagcggagcaggtacaatagtaggctacaagtcagctataaacatgtgtggatgagataaaagaggatagagaaggaaagcgagctacaaatttgtagccagctgcagcacgtactccaaaacgttatgtgtgtatgagagataggaccatatattaatgatgtagtatatgtttatattatatgaatgaactattaaatttgctatagatgatttggagctaatagttggctatactattaaacttgctcttacgaaactgggaggaaaactaactcatttttcgtgcacatgcttcccgaactgctaaacggtgcatttttttaagttttctatatgaatattgctttaaaaaatcatattaatctatttttcatgtataaaataattaatactcaattaattatgcgctaacggctgacctagtttttttttatcttctcaatcttcttcttttccctcctctcaaacacacctactgctataaaactcaacttctatgagaccagatcatcaagattatattatccattcgattgaaatgtctttctctatcaattatcatattagcatttctcaacaaagcgacagggccatggtattgccccgtcttctcattattttcctacttcttccatccccatgcccccggggtgccactcaatgggctcgatgtgcacaggaggatacccaatcacgcatatcggggtagaggcatggcgctcctcattcgtgcatctcggtggcgattcaaatgtccaatggatcagctttgtctatcacaactcctcatctactaccaccacagacaatgattaatctgtgacttgttatccttgtatgacacttcccaatccgttctagttttgccttttttactagaacagtttaagtttaatccctctctcagccaccagtcccacaaagtggcaaatctattgccgctcacccctccagagtggtaaaaagttgatgattactatcaatgtcttgaaatcaatttgttttccaattattcattctttgtctgattgtcccccaaccatttttttcaattgctggtttatctcccatttggttcagttgatcttcattatattccggacctcaaagcacaggtaagttatatgttttaggtgaagctttaattctagggataagtccatttgaccctccccccccccccctcaacttttcacttcgtctaaaatacacccttaaagtttaaaaccaggtattttacatccccgaactttcaataccacgcagtttaccccctgggtggtttctatcctagtttctgcaattaattaatgagaatctccggatctgcaattacacataagaaattgcattgaattattttcgatgtgtcttgaataagaccgtcacgtagccggcgagcagctcgtcgccactggtgatgatcgcgtcatttaattgatcaatcgaaattgcatgctcccatttaattttcgatgcgttttgctgtgtaatcgcataccgctggagttgattgatcgatcgaacagcaagatgacgaagcgcgccgcgagcagctcgtctacgccggtgatgcacgcttgacagtggaacgtgcggtttcgctatggacggtttgcatggatcggtgatgctccgggcggctgccgctgccagtacaccatgcaaggacagaaactccgtcgccgctggtgcgtcgagaaggtctagcgagagcaaccgatgcgtttgcattccacgcttcgccggcggtgcatcgagaacctccggccgtggttgttcgcattcgccggcggcgggcggggcggcaaagacgacgaccaccacgggccacggcggcggggccgcgggggcggcgtccgtgaccgcaaccgcatcctcatcgccaagtgcgcacgctcccagcggtgcggccggcacggggactcgtacacgcagtcggcattcgacaccatcctcgctggctacgtgacggtcttcttccacctagactcaggctacacccagcaccagtggcagtgtggcacctgctgcgcaagcgcaaccacaccacatgcatggcgagctcgccatcgctcgatctacttccatggtggagctcgacgaggcttcaaggtcggcgccggggagctccagttgacgtggctctcctctttgcgctgtctgcgcgttcataggcatcagcgctcgagctgaccaacccggtggctgctggcttgggaagagggagaggggaagatgaagaatcagtctgagatgtgggacattaattattttctaatatattttgctgacttagattgacacgtcagcgccacacattggcgaaaccaccatatttcaggacgggggggtgatttgaatggttttaagaattgagggacgtattatacccggttttgaagttaaggggtgtatttcagacgaacgctatagttgagggggtaaaatggacttatcccttaattctatggtcatgccaatcacaagtgcaagtcccctcttatatctcactaaatagaaaaggtttccttacctttctatacttttatttatctttcatttcttaccattaatcacccacaaagatcgatttcataattattcaatgatcgattcaggactaaatcaaattagaacatttagaatttttatcctacaaggagacaacctatatatttaattgctttctttaataattagaatcatgtaaataaatgaccatatgttatttctatgtcatttttattttatttttttcatagatataagagcaaatatgagaaatgtcattgacaagcggctcattctataatcaaactttggtatctctattttgtagtaatactatataaataaatgaccataggtttcaagtgatttgtgttctttattatgtgcattgagaataatactttgttatctctattttgtagtactagcttatggacgttagagcaatgttatcttatcattggtcgatcctaatcgccaagggactgattaggtcgattaatcgtcaattaacctcaattaatcacctgatcaatattttgtatacacggactagtacgggcgtgtttggttacctgcatgcatggagggtggctcgcatgtgtgggtgcaagaggaggttgtctggttgcccgcacggtcgtcggggcttggatccacgcatgcaaaacggcctccgcagctaggcccgcgagaaacgcccgagttgagcttcgctccccatccaggctgcgcttgtgcaggcggcgtgacgtgcgggtgcaggcgcggggatacacagatgcaggagggcgagaggggtcgcgctcccttcacctcactcctcctcatttgctcgcttggcctctactcggctcatcgccatcttcgtcgccgcacagccatcttctccaccagaaacttgcctggggcttgccttcctcctcttcttgtcgtagcctccaccaccttctccaccagaaactccacccctcctttctccagcgactggaccgcgcggatccggtgcccacaagcttctaagcggtagatctggagcggcggcgacaccatggtttggggtgaggccgcgaacgacgagcggccaccagatttggatgctatgaccgcgggaagtgcgcacagcaagctccatggtgagctgcagcacaagcgagccaggggcgacgctgcaggtgagctgagctgcaggcgttggggatggcggcgcggcactgtggatgtcggcgatgtggacggagaaatctcgtcaacgcggcgctctttcttctttctttctcttttcttttttttttcttttcatttttttcgtctattcatgagtaaatgctgtgcatcaatgctgtgcaatgcgcacaccttttgaaactaatgattgtttttttcctgtttttttaattgtattttctatctgtttatgttgtctattaaaaagtttacatgtatataatgttgttagagattttaaacaccattattactttttacatgtgataaattattcatgtactcgttggttaatccattttttttcatatgatgtcgcagtggtaatcttacctaaccaattgaataggtaagcacactcaaattcatacaaccaaccaaacaaaatctcccttaaaccgtatttctcatacaagcaaccaaacaatgtcttgtgctagtcaggctgaacccatgcaatcaaccaaacagctgcatgtgtatctcctcaaccaggctatactcagccgataagagagatggaccaggctagagggtgcgagcaaccaaacacacccttaagtttagcattatatacatgtaaactttttaatagacaagatgaacagatagaaaatgcaattaaaaaacaggaaaaaaacaatcattagtttcaaaaggtgtgcgcattgcacagcatcgatgcacagcatgtactcatgaatagacgaaaaaaatgaaaagaaaaaaaaaagaaaagagaaagaaagagcgccgtgttgatgagctttctccgcccacatcgccgacatccacagtgccgcgccgccgtccccaacacctgcagctcagctcacttgcagcgtcgcccctggctcgcttgcgctgccgctcaccatggagcttgctgcgcgcactccccgcggtcctagcatccaaatctggtggccgctcgtcgttcgcggcctcacccccaaaccatggtgttgccgccgctccagatctaccgcttaggagcttgtgggcaccggatccgtgcggtccagtcgctagagaaaggaggggtggagtttctggtggagaaggtggtggaggctacgacaagaagaggaggaaggcaagccccaggcaagtttttggtggagaagatggctgtgcggcgacgaagatggcgacgagccgagtagaggccaagcgagcaaatgagggggagtgaggtgaagggagcgcgacccctctcgccctcctgcatctacgcatccccgcgcctgcaccggcgcgtcacgccgcctgcacaagcgcagcctggatgaggagcgaagctcaactcgggcgtttctcgcgggcctggctgcggaggccgttttgcacgtgtggatccaggccccgacgaccgtgcaggcaaccaaacagcctcctcttgcacccatacatgcgagccaccctccatgcaggtaaccaaacacgcccttagaaggaggtgtactaactgtcgaaggaggagctcatcttcctagtgccgacggtgcttgaggcttgagtccttgaggggcggcaccataggagccatctagctcggcagctctagcagcagaccaggtgaagggaagagagagatctaggcagcagcaggtctagttctagcagcatatcagggtggcggcttgagagagggcgacggcttctgagaatagtggtgacatgcagtggcggatttagtccatttctgtggggtcggctgaccccacagctttttgaaaaacatcttataaaccttgattttcatgtataaatctaaaaaaaattatagaaatgaccccacttaaatataaaccactagtaattgaccccacaggtataaaatcttggctccgccactggtgacatgccctcatgactaaaccctaaggagaatggacccagcttcacatgcagccaagacttgttgtgagatcaatataggtgctctaatcggacgattaatcgtgcctgatcgccaattaatcggacgatcaaatttctagtcaacctgattgaatgaatgcccatgatgggatgattaatcgtgattaattggacgatcagataagatttctttatagattcattaattaattgttctgaggtggatatcaatttgatagtagatcaatatcgataggtacgataatttggtctttggtaaaaaaaatgtgcaagatataacgtgaatggagagaagaggagaagtcacgattggaaggcaaatgttcgtgaagataggcacatatatgtatcgtacaatgtcctctccgcttgtcgaaatgcaaataacatcatcgggggatatgatcatcagttcacgagaacagaggaagaaacaaaagctaaaaattaaaaccatcaacagcccgatcgagtttgcattactagatacacacattgcagccttccttccctctctccatgtatcgatatatcaacccggcacgcacaaaacatttgttcattccctactcgagctgcgcgtaccacaccccttggatcttgacatccttggcaccttggcgccgaggtctgtgtccgacggctgcacgctctcgaagacgccaatcacctcgccggtctctggcttgctcttggtgacgctcaacgtgatgttgcccgtcgacgacgaggcgttcttgacgttctccttagcgagctcctcctcgtctcctctgcctccggcggggagcgccacagcgttgtcgtagccggtagagccaccgcggccctttgggtcgaggaaggacgaaccacggtagctgggcacgaggaagggcccgccgaagctctccggcttgccggtggcgaccagattcttgatggtgaagaggaacggcacgcgctcgcctcccggcagctgcacggtgacggcggcgtagtcgattccgtccttctcctcgaacttgatggttccgtcggagctgacctcgagcgggccctcgatctcgtcgagggtgtaggtcaggcgggtcatgagcttggtcttctggaactcgggtggcgcgttcttggccacgccctccgccttaacggtgaaggacgtcggctccaggcagaacttcttcatgttgtacttgccggccttgaaggcgaaggagtcgacgccgccctccaccgtcgggcactggttcgccgtgccggttcccttcacctccatgtacgtcttactctgaatctcgtcgaaggtaagcctcctcggcacgccctccgcgctggcgccctacaccggccggccaccacatgcacggcgttacatatatagtaattcgatcgtttccaccttggccttggccatggcgccatgcaacatactcctaaatcctaattaaggtcttaccgagacgagcagagctgaggtggcgagggcgaagccggcgagcttggcggcatcggcgcacttgttggcgacctcccggatgtcggactgcagggagcacgtgatcctgccggcggcaccggtgtcgacgccgaacgccctggcgacgtgcgaagacgggcgcgatggcagcgcggcggaggaggcccggccgccgagcttggccggctgcatcagggtggccgcggcttggagcgatgctgccatgtccgctcgctcgcctgctcagctctcagttggtgggtggtgtggccgtgtccgtgtgggttgtatcgtgaagggcgttttgtgagggcgggacagtgttatctatcgcagagcaaggggggcagaggaggataagaggattggataaggcgtggcctcccattggtggcttggggctatggtgatgctgagctggacgtcgacgtggcacgcccaggtgccactccttccccggcgtgtggtggtgggctctttcatttgtggggctggcgctgtgaagatcctacttccagccaacgaaggcttgccacgtcaggaatggagagacaaacgaacctattctcttgaaggcacagggaacccaaagaaaatgctaaaaattaaagatctcgctcataagaccgacatttgtaatgtgttagatgaaacaggaattataaaaa

SEQ ID NO: 69572 - DNA, 60730 bp, Oryza sativa
  unsure (1)..(60730): unsure at all n locations
catctatactctatggtggtggctgttggtatttgctacgcatactgataaatccgtaagcgcacaagtaatgatgtagcattttctcttagagtattttaagggtatcaaaaataaagacgtgtgtgtactatctacaaacagaattcccccaaggacaacaattgatgataagattggcaagagaggattcatatggacttcactagttgacttaagttaaagatagaactctatcgtatgtttcgcaccggctatcccttaatctgttaggttgagtctggccttgagctatatgatatgcccgaacgtggagggatgcaaagtacgggcagggctgtcaccacctgctacccacctcactttgcgtggagcacacaatctctaaccttccacagaaacttccttctttatagagtcctagtactagagcagttgcaactaagcaacgaacccgcatcgatgagaatatttatcactcaagtaaactaagtaaaaaaaaactttactttgttgtgtgttgtgaagtgtgttgagctcctcctttcatagtgccaaatgatggttgtaatggtgattagtgaggttggtgcacacataacagccatagtcaatccaatggggagctgccacattgaaaggggtagccaggggcaccacggcttgttcagccgaactaggcctccgccttctggccaccgattttggacagttactgatacgtggactcttatgacggttaaagatggtttggccctatctcaaatcggttttgacagtcaggtgggccctttagttcttgtgctcgcgcttgattagtcagatgggccctttagtccttgtgctcgcgcttgattggccagagcttcatttttgtcagatgacggatgtattttttccttatttgacccgcatacttatatgtatcaaaactaatggaaatggttagtagtaaactcctaccactaagttttgatagtgtattttatttttttaacgcaggagttgatggttaaagtttatacttaacgtcaacaatggcagtgaatccgccaccacatcaactccattttattttttttatcaactactccttatgtactttatttttatctaagggacaagtgtatccataattcattcttatccattgcaaagcatgaatatttagctagttataaaaaaagcaacagtatagtaacaactttaaaagtgattttcatataaacaaaaaaaaacatgtttttaaggtaaaaccgatctttcaggaatagatcctctacgaaagtagatagatgatcgtcatacatctcttttgtatatattttgtgaaaaactgtgctagctcaccgaactaaattctgtaacatatgctttagtccctaattcgtgtcttcacacatatatagggtttgtttgggggagcgtaggattccgaggagcagttgggtggtagtcagctcctcagaacctggaaaagctgggttttccaacttctaacttctagtttatttcctcgattttacaactacagcttctcagagtttaaattaaaagctagactatttggagaagcttctgattctgggagaagctacagcaagtagaagctctccaaacaagcccatactttgtatctaagtctgcttcaacactttatctccatctatttgagattaatcaacaccaagaccaacaaagggagaatctgcatgtgtggataatatataaacaaattctccacaagtacatttgctctaaattctgtctaaattttgtaacatatataaacatcctctccgaattaaattatgtaacatatgctctaagggaccacctatatgtttgtcgataaattttctcctacaaatttgacagatgcaattatagtacaatcgtagtgtaattacactgtaacttgcatgtaagtttcacgtaattttgaattgttagatatattacaagatttgttctaatgaggaagaaaaaaaatcacagaacaaacatatgtgaaatgatttgttcccatgaccttcattttaccgaaataacatgttacagagagatttttaaaagttacacacaagttacagtgtaactacatgtaagttacagtgtaattacactacgattgtactatgattacatctgtcaaatttttgggagaaaatttgtcgttaaatatatagcacaattgggagaatttcgtttctaaaaaagttttagggaataccatgtgtaggcccaggcgcccagcctattaacgacccaactagggcctgttcaatgcgggactttcagcttctcagcctcagtccgagtcgaaggccgtagtagatctttttgctcggtgagagaacccgttaacggtgcgccgctgctttgctgttgctgtgtcgtgtggtcgtgactcgtgtgactcggtgcgtgagcataatccacacttccacagagagagcaagacgaggtgaagcggcgcaagcaacagtgcaacacgccaggcaacacggaagcgactagcgagcgagataattatcatcgtccactctatccgcctccagcttgccccgcctcggtcctcggaggtgtaggagcgaccgaccatggggagcgcgggggcgctgctctcgcactcgcctccggggctcggcggattccctcctcgccaccatcaccaccaccgtctctccgtcctccgttgcgtaccgctcctcccctccccggcgcccgagcccctcagctgtcgccacggccggcaccttcgctgcgccgccgtcgacgggggagccggccgggagacggagcgtccctcgccgcccgcacctcagagggaggagtcgccgtcgggcagcctcggcgcagccctcgaggacccatctcctcaacctggtgtgccccttatccttctccctttatgttgccgatggtacctcaagtactcactagcgagccgtttccttggctggaacaagtgttgcgattgaactgggaactggacagctgcttgctaaaaatcatgagaaaaaaaatgttacgaagggaatgaagaaacttagtagaacttcaggcatcctcctggtgtaaccatacgtgctacagatttaacaatcaacgcaatgaaactgtagattaggaatacagttttgcatagcaataccaactacagatttaacaagtcgcttaacatgcaatagttgctgaccgtgagctttcattgattcatttgagcttcatatatatgttcgtgaaatcttgttctgggtatattgagtactccctccgtttcacaatgtaagtcattctagcatttcccacattcattaacatcaatatgaatgtgggaggggctagaatgacttacattatgaaacggaggaagtagctaaaaagcagggggctatcctcctttggcatatctgatactaatatctaattaccccacacccaaaagacagaaaatctttctagagtgcaaaaccccagctttgagtagctaaaaagcaggggcctatccgcctgcggcatatctgatactagtatctcattactccacacccaaaagacagaaaatctttctatagtgcaaacaaaaccccagctgataagcaatagagatgcatgtgatgctatatgcttggtcaggtcagtcataagacgtgaaggctatctacaactggtcttaactctgtagttatgctaaggaaatctgctctgaatatgtagttcgtacaacggtacaagtgggttccaaatctagtcgcttttgttcttaacccatctttatgatcacccattatagatgtcatttgtataatcacctgttagagttccaacattttataaaaccattgatgatctattatgcatttaattttgttttccttcacttgatagttactatttttgaaacagttatgctaaaattaagttgtcaccttatcattgtatcaggatttagtgaaccatattttgaatagcaatgctatatcagaagggccatttagtatgagaaaagctagatttttaggctctgcttcagcctttagtgttaaacaaactgagtggccatgtgctacaactgactcaaagaaatgttaccgtaagttgctaagcacgataaaacaaagtcagttaatgtgtaagcacatactttcaaaacttcaactcaaagtttgcataatatagtaacttaaacaatgaaatccatcatgcagacataattgtcatttagcataatatattttgcataatatagcataattgtcataatatccttaaatctggaagttaggtaaaaactttcatccaatccacaagccacaacagaagaacccctaagtcctatgtgtgtatgcttccaaacatccacagaagaatcagatgaaattcatcatcaacactagctgtgtcttttgtaggagtaaaggaaacaactggaagagttgaatggatgaaacttatacagttttagatttgttgtggctaaaatctttaggctcaattttctagaagtattaaagaaaaatctatgtcattgcattgtacttatcataactattttattcccattgtgtatttttctggtgataactgctacatttatattcattgtacaaaatgcccttaattagtattatacgttggtggagttcctttttagagtacttgacaactcaaatttaacttgtacagtccaaaatggatcttttggaggtatcacagaggatgaagaacagagtagcctgtacaattttctttatccgagcaaagagctacttcctgatgataaggagatgagtatatttgatcatctagaggaacttcgtgacaggatatttgtctcagtattggctgttggtgctgcgatacttggttgtttcgcttactccaaagatcttattagaattctagaagcaccagttagtgttcagggtgttcggtttctgcagctctctcctggagaatttttctttacaacattgaaggtaaaactcttaacaaattaacatgacatactctaaatgcaaattaactttgtaagttttgcatctccctatggaaccaaccttgatgcttgagtaaattttgcaaaactccaactactttgataaaactatcgcagaagtacatatttaagccacatcattacaaaactacaaatttaggacagtatcacaaaaataagtagatttggagttttatggtaagccatggtaaatctgtagttttgtggtattgtggcttaaatctgtaattttgtcatgtttttgtcaaaatatttgtagctgtgtgaagtttgctgtttcttattaaatgtttcaacaatgtgcactgcactttgaagttgatcctggtcctgcgtggtgcgtagcacatggactggttttagtctggggagtctatccgttgtaaaggcatttagtgcaagcatattgtcatgggcattaggccataaggccaaggcccataggcagcccataccagttaagttagagataagataagattaagtcttacttagagttcaagttataccatctatatgaggatgtgattgtgtctattatcgattaagcaatgaatatcaattagtctaatctctccctccccacaatgttcttctccctagcctaaatctacatcccttctccaggagccgacaccacccggctatccttccggcggtggttatctcgtcatggcctcgggtcgtgacacatatgaactgtactgtagctatcaaaatgactatcattaagattgaaaatatttaaatcctccctcacatggtcaggaagcttaaacacaagtcgacatgtgtgggactgtttttgcctcccaggcccccatataatcacaacacaaaactgcaagtagcttcatttgcctatgcctgttgaagctagctcaggaagtttctcacttctgagtgccatgggtagcaagattggtgcagaaggaaaggaggtgcaggtttatgactcgtgtttttattacgtgtacactaggctcacattcacaaaaccacacagtaatgcacactgcctcactcgtctataaactgctctagagaccactagagtatataatcatattcattataattttttaatcaatcttcttgtgtactagatgttaatgacgcttatatcctctcatgtggtcgttaagcaattcgactcttgctgacattgttatttcaatgatgtgcaggtctctggttattgtggccttctacttgggagtcctgttattctgtatgagataatagcatttgttcttccgggtttaacaagggatgaacgtaaattcctagggcccattgttctgggctcttctgtactattctaccttggcattttcttctcctacacggttcttgctcctgcagcattgaatttcttcgtgaactacgcagatggggcagtggaatcgttatggtcgattgatcagtattttgagtttgtgcttgtgcttttattcagcacaggattatcttttcaggtaaacacatggtcttataagttttcttttttaacacagtatcaaggttgattgttgtcatattgtcctctgtttccacatgttgttgtaattgtagcaaacatagtaggaaagccagttcatggtaaccattactttattgacgattgaactggttcggagggtactgcctcaccttctgcgaagatcgtcgtccagatttctcataatagaataatttaatgggtgactgcagatggttaatctccatctttaacctgagtctctaccttcttatcataaaaatatagagattaactcaatcaatcatagaataattatgtaatctgttgttcttgcgggtgcttttgttcaatccatggttgtagtgatagggcaaattcaaagcaactaggtaagtaaattctatggacaaggttacaggatatcttgatcttgcataatctactcggttgccaattggtgttggaacctgtatgcttgaacaaatcattatttgatctaactgtttcaatgctcattgacttgttatctggtgctaatataatcatcaattaaatggctggtgtggaaacttctctagatgttagtgatctgaattatcagtctgatttactgccgaagataaagaaagagaataattgtagcaggaccatctcattagaatgaatatatcccctctcaaagctgaatgaacataatatcttgtatatttttatagtttccatgctattttttccaggtccctgttatccagctactgctggggcaagtcggtttggtttctagtgaccaaatgctttccatctggagatatgttgttgttggcgctgtagttgctgctgctgtgcttacaccgtcgacagatccgttgactcagatgctcttggctggtccgctgcttggcctgtacttgggtggtgcttggatggtcaagctaactggtcgataattcctactagtattttgtattaattagcatcatagtcatggcggtggttctggacaaatcgcattccccattgtaacatagttcgtataaaattaactctttttttctcttcaacaaatctcataaatattgtttttcctcttcttttgttctcctacatgctcctgaatcttatgtgctccctccaatcatctatttgacgttgggagagctgatgactaagatctcctaatgtcaaaaaaagattgggagtacatatgcctctacactcaaaaagatgtacacaagcaaggaggggtacatttttaatactccctctgttttaggttataacctctgttttaggttataagttataagacgttttgactttggttaaagttaaactgttttaaatttgattaagtttgtaaaaaaaataataacatttccaacctaagacaaatttattatgaaaatatattcaattattgatttgataaaactaatttagtattataattataaatattactatatttgtctcttgaaacagtttgattttgactaaccaaagtaaaaacgtcttgtaaccccttaaacggagggattcaggagcggagggattcaggagggagtaataaataattcatttgttcttgaaagttaattgactattgccctgcatttttcaactcaccttgcttgtttaccccaaaattcatgacatgaccatttcggccttggttaataggatgtgctggcatgggagaaaattcgttctcacctataaaaattaagtatgatgtttggttaatacttcccccgtttctaaatatttgacatcgttaactttttatcacatgtttgaccgttcgtcttattcaaaaaacttttgtgaaatatgtaaaactatatttatacatgtaagtatatttaacaatgaatcaaatgatagaaaaagaattaataattacttaaattttttaaacaagacgaacgatcaaacatatttaaaaaaaagtcaacggcgtcgataacaaaatcggtagtgatgattcaacttaggcggcaagtactgtaccttttcatttctttcacgttacgactagtagccatcaaaccaatacgtttggaaaatatatagtgaaaatccattattactacataaccattattactgcataattactagaggtaagtataggtataaaatacatttacaccaaatcttaagtttatactcagcttcatttgatagggaaaaaaagataaattttaggtgaatagtgtcctactactattgatctgatctttttttaactccctaataaaattgagttcgaacttgagattggtgagaatatatttcatgcctacacctatccctagttattttttgcatgaatttataaaacttttaggtccaattttaatgggttttcatttatttgatggttttcaccggatatgctccgatgtaggtatttgtgcgcaaattatttagatcagtgaattcttgtaccctagattgggttcaaaccctagatgaattcttgtaccagtgtgttggtgatatgtcctagagacaattaaagagatgattatatcacatactatgtttatatatttatcatacgttgtttcttgaaatagataactcattattgattaataaatatgtgagtccttcaagagacttttatgttgtatgttgttatttataaatgatccctgatgaaatatcatatgtgtaacaaatatggtttaatgattagtacatatattgattgatgatcatgcctcatagatcgtggtattaataatgtagacatatgttggggagcatgttgctggataaactcaatatgaggcacatcaagaactatatgtgatgtgccatcagtgatctcatttagtgttagttagaaacatcagacctgagattatcatagttcccaacatatgtagtcgcttacttaaaggttggtaaacgttactccatgattgggtacttataaaagtagtcttcgggtattttatgaaacatgtagttagatatgaataatcaagataagatttgccccttgtcgatttctaatatcggcaatattatttatggggtgcactagatcgagaagagatggtgacacagatttgtactggttcagaccctgaatgtgaggaaataccctagtccagctggaatagattggatatataccggtgtgcgtaggttagcaacgaaatagccaatggcgcgtatgaatcatggagtgtctaaccccttagggtttccctcggcgccctttgtatagagctagggtcgccggtagttagatggtaaggttgcccttataatttaggcacctaccatctatttataagggataggattaatttccttatcctacatctttttcttagcttacaagttagccgcatgggcctagggcactcgccccatcctatactgcacggcccaaacgcctcctcttaggtactcgggtaccctgtacctcatactacctccgtcccattttaagtgcaaccatgatttttcgtgcccaactttaattgtccatcttatttgaaaaaaattttcaaaaaattgaaaaacataagtcacgagtaaagtattgttcatgttttatcatctcataacaacaaaaataataattataaaaaaaattcaaataagatggacgatcaaagttggacacagaaatttatggttgtacttaaaatgggacagagggagtagtagccaccgagtattgagtttgatgaaggctagtggcatccaatgaagaagacgagactggctaagtactcctcccaaaatctccaaaaaaaaaataatgcaatatgctgccgagtttgaatcagactgctgatagcgatgtttaccaaacgggggaggctttccagacttccttcttagggaaccctttcctgggctggcccgccgaagataccgagggccataaataccccgggcgggagtgccgttgccctagattcccaaatcaaacaattattttctcttcttcttcttcttcgtgcgcccaaacttctcgtcttcggtgatttagggttttctctccccaagcagatcggattgaatccaacagatccaacccaggtccgcctctcttgttgaagctctctactttccgctgtcgccatgtctcaatccacaacggagtccgtcctaatccgggactaggccgcttcctagacgcactcgacggtgacgatggtgatgctggaggaagctgttgaggaggggatcctcccttctcgggatctcatcggctggcggggggccaccggggaggagttcccgaccctgaacaccgacgatatcatggtgttcctccccttctttaggtttggcctcggtcttcctgccgacgattttctccgagggctgcttcatttttacggtattgacatccaccatctcaattccaacttcatcctccaatcgccatctttatccatctatgtgaggcataatgcggtataaacccacacttcacgttctttcgttacctctatcaactcaagccatagccggggaagaagaaccccatggtggttggagggagcggcatccagatctggaccgagcggaaagcggagtttttcgatctcctgctcaggtctagcacaagggctggcactctaggtgtctactgctccaacttgttgcaggtctgcctccatataatggccatgccccgggcgtgaaggattgttggtacacactccctagccgcgatgagatggaccaagttagaggggtgctgaggggagtgcgtcttctaatcgatgctggcttgacctgcaacttcgtcacttggaggattcaaccactgaagagtcgtgttcacccagtctgggaatatttaggaaaggatgacccgaccagggagagcaatgagttgattgacaaggaccaggcttccgagaggttgaactagtttttcgagcccgagacgttggtcagcatggaagggtgctccaatcctttcaattgcagcaagaaatggccggaggtatgccctacccatgcctgcttcatatatatgtgtataaattggattgtgatcttcaacatctatgtccttgcagggagccgtgacctttatctccaaccctccactgcttgggacctcgagcaagaggcgtgttgacgatcccccttctagtagctgctctttcaagcatgtggcctcaaagcagccacgcaccccgggtggccaaccggtaggtccaaggttagtgatggccattccactccaaggatcgccgagacgtctagcaaggggaaggacgtggtggtgactcccgacccggtctccaagaataagttgataggttcgccgggataacccgggaatctaggggcaacgacgagggtggcggcgtctgccgctaaggcctcaaaggcaccaggagtggtagcgaagacgatgtcaccccggtctgaccaagggaccgaggataggggtctgcaaggttcggcggtccaccaggttagttgtgatggtggtctcctcttgttcacttgtatgtaatggaatcgtcgtagactcgtggtgattaagcgtagagtgaatgtagcatgtcgtcaatgcgagatgatttgagccagctccagtcggcaaaggatgccgacagcgcctctacttaggccactctcgagtcgggtcaagagaccgccgcccgggtggatcggggctgccagagccggcacctccgggcccgaggtggccgggcagaccacaggggacctaggcgagctaggcggtgacatgacagcggcaacgacgaaggacgcgacggatcaagggaccgacgggggaattggcggtgggggctttgtgagctacaaacgagacatcgcatgcgcatatgcctcctcaccattctccgttgcgagcttctcccccgtgagcttctcctctgcgagtctcctccatggacttctcctccaccgagtcctcagccgcctccacaccactgacccgggaaggagccggttggcgaggatgaggaaatcgtggaagaaattccgcgtcggcagtgcgcgctgctgtcgacccagtatgtctcgcccctccaaactgcctggttctggggggggcaaaaaggggttcgatgatgccgctgacaaggccgactgcacgaccatgtatgaggcagggctggttctgctggagaagatgcaggttagtagttatatcccttagcccccgacttcaggacagagtgcgagtagttattgtgcgctgaagtataatggagagtgggtcttatctttgtttgcgtctagccgggtagatccttgatggcgtggcatagtgctgggtggcggtgcgccacatcgtcatgtgcagttgtcttgtttttgagccgggtagcccccgacttcatgttgggacgactataggagtcgtagcatggagttgacttgattgttgcattgattcttgcagaagatagtcaatcgctctactgccaagagcgaggcgctgcggagcgtgtttgacaatatcacagagatcgagcaaatctagcgggccatgtagcgtgtcgatctccaccgactgaaggaggtgaaggaggggcattaccgggagagggagctctagggccagatttgttagctatggagggacggtgagttgctctggctgagagactttgtctttatgctagcctttttgatggtgtgtatatgttcgcagtcgaggatgagcgggagaggggcaaacgctaggcggcagagtggaagatgctggtggactaggctgaagcaactggcgggtgggcccagatcgtcgaactggaggcgtagttgcaggagtcctgacagggtgcgcaggatctacaagacaagttggatggtgagtcctgtaatgcgtgtttggtctgtttttgtactctgctattattgacgtgttttatcttgactgccacgcaagctgcaggtgattggcccacaccatcccgctgccccatcccgcacgcctccactcggtgccgcgtgctcctctcctgatcgacgtcttcttttctctccttttttttcgttttctaatttcccttttcttttctcgcgatcattctgtctcctccctctccttctaatctcctctacttcctcctcttttctcttttcctctcttttcttctttttttctcgatgtgtgaggctatgaaaagttgtaataagggattcttcatgtgatgacgaatgaagtgagcacagccgagttcaatattatatatgatttataactttgttttgccattgttttgtttgtcttgttttggtttaccgtttaaattatcggagttttttattaatcatgaaaattattcatatgttgcaacgcacatgcattttcactagtataacaacataaaacatgcaaccatatatagtaaagtcataactcacttgagtaatatttatagtgcactatgatcattagatttataacaaatgtcgctctctaatttattctactttatccatataaattatagatatttatgtgactacatgtggcattgaatattatcttcatacataattagttaagagaattctagattatgttgaggtaaaatatctcctaaattctaaaaattagttatgcaacttgatatcacagtaattactagtaaataatgtaaaaattactactaatatgtcatgataactactactccctccattccatattataagtccttttgacatgaccaactttgtacaaaattattaacatctacaacactaaattaggttaagtaaatgtaatatattttgataatatgtttgttttgggttaaaaaatataatctatttgattaaaaaatattaattcaaataacatgcaagtaaaaatggaaaaaaatcaattagaaaatgttagaaaagatataaatataacatatttcaaggtggccaagtatccatgcgtaattgtgtccacgaaggaagagaaattgtcgtgatgggtgccttgaggatatttccccgtttgctcggcgtcgacctcgattccttgtgtggtgtggattccttagagttgttgctaaaaccacctactgtagttgcaaaaatgtctaccatccctttgtttctactagctaaaattatttcttaattaactctcataacaagtgttgatttagtgagaaaatattttccttttaactaatgtgataagcgacacaattttgtatatcctcatgagatctgtttatcctcattctacatattgaaatattttttcttagacaacgctacttggaattgatctaataaaacaataagaaaatagatatattttctagattacatcgtgtttgcatgtttttttgtgtaaagagtgtgttattttatttagtgttagctggagtgtaatcgctattgtcggtgacatggggccgggggtattgtgactagaggcttgggtagccgcgatcactcacgtggcccgacctcctcgggggggtcgggcccgacggtgacgtggccacccctccctctgtctccccgaggggtcgagccgctcccgtttcggccccgagggctggggcaccccgaccccccgtggtgttggcgccacgtgtgtgggttaggtgagcacaccgggctcacctaaccgcatttatagcaggttggacgagcgcgccacgccgcatttaatgcggcgcagcgcgcgcttatccggtccgtgactggtcgtggtgtgtgaccggtcacagaccggtcagatcgcgggttaggtggcaacaggtggcctgtcgcacgcctcgccccgtcccgtcggaatgatgagagcttcctggctctcgtctctagccggagctggcgtgctgactcctggagttggtatgtcagtcccggtcagatccattccaggcttcagcgcaagcatggcaagaaagtcgctggccattgaatgaaggttgaaacgggcgtccaccgggagagctgacgagcggagcaggaggcgtgtgtactgcttgtcagaggtcatttccggctgtagattagccctcattgtaaaaagcatgtttcctttcttaggtagcgggaggcccttgtggtgaccccggaccagataaaaaggaggcccaggcctaggaaagaggggagaaaaaaaaagaggaaggagaaagaggctgaactctctctcgctctcgatctctctggctctggagctctctgtattccttcacacacagatccaccagaacacaggagtagggtattacgcttctcagcggcccgaacctgtctacgtcgcccgtgtcttgtgcgctccttctcgctgacattcctcagatcgagggcgaagaacctcacatagcgcccccggccgaaccggcaaaggggggcctgcgcggtctcctggtgaggagcccccacgctccgtcatctggcgcgccaggtagggggcgcgcgtgtctttctaagccctcgtcctctttcgtgtgcgccaagcttctcccgctcagcccaatggccgaacgggcagtggcgcacagcctctctccgagcgctagcggtgacgacggggagcagaacccgcgccgtcgggctcgcaccccaccgtccccctctcgccgaagtcttcggcgagggaaggcgctcgaggaggtcgaaggatccgtgacttcgccacgcgcgggcgacgggggaggacggcgagacggggcgcatcgccgcctcgtctacggcggtggcaacacaccccagggcacgctccaggctgcgggcgcgctcctgcgtcacccgcccgtcgtccccgatccagagactccagcccgacgttggctggatgacgtggccgatttggtcatgacggcacagcagcgcctaggcgccggcaggcggtcctccgccaccggaacctctggcgctgccgccgccggctccacgacgtcgaggcggagggcgcggcgagcggcggccgctacccgccgttcgtccgccattccctcgtcaacgcctccgacccaagaagatgtgcgtggggggccggatgcccggctcgatatcgagcgccggcgcgacgatcgtcgcgccgcccacgcaacggagggcgcttcctcgtccggagcgccacttcggtccgggcacgggggccggccccccgtgtccccggttggcggtgctggctgtcgagcctttgtggcgagccttcggaacgtccgttggcccccaaggttccggcccaccatcaccgaaaaatacgacggaagcgtcaaccccgccgagtttctccagatctacacgaccgggattgaggccgccgggggtgacgacagggtcatggcgaatttcttccccatggccctgaagggtcaggcgcggggttggctaatgaacttgccacccgcgtcggtccactcttgggaggatttgtgccagcagttcaccacgaacttccggggcacatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcaggggggcgtgcggcacaaccgtatgctcgagaagatcgcctccaaagagccccagaccaccgcgcagctttttgagctcgcggaccgtgtggctcgcaaggaggaggcctggacctggaactcctccggttctggtgtggcagctccggccgcccccgggtccgccgctcggtcagggcggcgggacaggaggaggaagaaggagttggcccgttccgacgatgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccccggcggctcccaccggtaactggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcaatggtggtttcccccaccgtttgcaatgtgaagttggggcgtgtcctcaaagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggatttcgatgtggcggaccttagtctgccctacaacgcggtcctagggaggcccgcgttggtgaagttcatggcggcggtccactacgcctatctccagatgaagatgccgggccccggtggccccatcaccgtccatggcgacctcaaagtcgcgcttgcttgtatggagcagcacgcggaccaccttgccgcggcgtccaagcccgcgggtggcgacgagagactcagcacctccgtcccggccgccccaaggcagcggatggtcacgtgcgacgaggtcccggtcaaggaggttgccctgggcgacggcccgtccaagaccacacgaattggtggtcttctggacgacaaataggaagacgcgctcgtctccttcctgcgggcaaacgccgacgtcttcgcctagagaccggcggacatgcccggggtccccagggaggtgattgagcaccgtctcgccgtgcggccgggcgtcggcagggcgtccccaggggtaccctcctgcttcctcttcccccgggcgtcggcagggcggctgccccccgggcccccgtcgcggggcccagaagcacgaccccctcccggggtagattgttcccccctgcggctcccgcccgcgccattgtggcctcggggggcccgctcccccgacgccccgaccacctgcatgatggtcaggatcttggcgcgctctggatcgcagcagagggggaggaccccttgggggatgagggatgcctccacggagctaagattcagcacccgttggaccaccatcctgaagtcctcagggtcccagtcccatttgcgcccctggtgggtcctcatgtagtcctcgggcccggtgtactcccaggcgccccgagcgcgccgctggagcggcgcgatccggcgacgaaggtagtcgccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcacttcgtcggcgagggggtgtgtagaaccaatcgctcttccagtcgtcccactttttgcggaggacgcagggaatgtagcggttcggcacctgcccccgcggctggaagtagcagccaccgactaccgtcggcggtgacaccggctgtacggtgaagaaccaccggaacagccggagagatgggcgcaccccgataaacatctcgcacaggtgcgcgaaaatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgcggcgccaggcgtccctcgcccagcgcgaccacctcccggccggtggcagattccggcatgaatcggcgcggcagcccggcctgcctctcgctcacgatgcgggaaggcggcagcacgctaccctcgagcggtacggagccccgtgccatgacgccggcggaggaggagcttgagagcgagcgagtatggcaagggtagggcgcaggaaacggagagtcagagcacaagtggcgaaggcaaggggaagagtggtgagaggaaggaaacaaatcccttccttggcgtctttgtacccttgccaacgctatgcccggctcctcgcttcccgcgcccactacctcgccccctcgtttctcgcgcccacgcctccactaaccccactcgcccgtttgcggcgcacgcggcagatgtgcggtcgtggcgtttgagatggggcagatcgtgcgcgcgtttactgcgctcgccaaccgcgaaaaacgccatcatcatgtccccaggcgaaacaaaccggctcgtcccgattcgcgcgctgcttgagtaatgtagcggtcttgaagaggccgctcattattgtcgatcggtttttcccttgccgatgcgcgcgatttgcgaccgttgggtttctgcccgcctgtggggaccggccccacctgtcaccgggcctaaggagtggcgtcacgcccgagcgcctccctcgaggggggcggtcgccctggcgtaacgccgggggctactgtcggtgacatggggccgggggtattgtgactagaggcttgggtagccgcgatcactcacgtggcccgacctcctcgggggggtcgggcccgacggtgacgtggccacccctccctctgtctccccgaggggtcgggccgctcccgtttcggccccaagggctggggctccccgaccccccgtggtgttggcgccacgtgtgtgggttaggtgagcatagcgggctcacctaaccgcatttatagcaggttggtcgagcgcgccacgccgcatttaatgcggcgcagcgcgcgcttatccggtccgtgactgatcgcggtgtgtgaccggtcacagaccggtcagatcgcgggttaggtggcaacaggcggcctgtcgcacgcctcgccccgtcccgtcggaatgatgagagcttcctggctctcgtctctagccggagctggcgtgctgactcctggagttggtatgtcagtcccggtcagatccattccaggcttcagcgcaagcatggcaagaaagtcgctggccattgaatgaaggttgaaacgggcgtccaccgggagagctgacgagcggagcaggaggcgtgtgtactgcttgtcagaggtcatttccggctgtagattagccctcattgtaaaaagcatgtttcctttcttaggtagcgggaggcccttgtggtgaccccggaccagataaaaaggaggcccaggcctaggaaagaggggagaaaaaaaagaggaaggagaaagaggctgaactctctctcgctctggagctctctgtattccttcacacacagatccaccagaacacaggagtagggtattacgcttctcagcggcccgaacctgtctacgtcgcccgtgtcttgtgcgctccttctcgctgacattcctcagatcgagggcgaagaacctcacatagcgcccccggccgaaccggcaaaggggggcctgcgcggtcttccggtgaggagcccccacgctccgtcagctattatggaagagaacatctttaaatttttttgaaaggttccctttaattcgacaccaatcaaattaattaggtgcgactgaggtgtcgtaattgatctcatcaaaagaaacataagaatagctagaagtttgctaaatccgcctataggttgtcaaatgggttgtgtctttctgtgtctgtctggacacacatttagacaactcaggaacaacatgatccgtttggctatgggttttgctggcacgaccgatccagccacaccgtgcttgggctgctacctggcttggtgtatcaacacgacaagtgcatgagcgagccagcacaacatggcctaggaatagcacaacacggcctaacccatacggtacgatgatgactggtgactgacagtcgccagtcatgaaactgtcatccaagcgggagctatgaggaaaggagatcgaaagaattgagtaagccaggagctcgagatagagaaagtgatggtggatgctcgtcgatataggcctaccacgatagcatggtggcgcggtcaaccctattcatgagtacaaccactaagcacgtggtcattgggactcaccggcttgggatgaaggaagtagaaagtgaagggtcacagcggtgcttgatgatgaggaagaggaatgtgctatcggtgagtgaaggactctctgcatcagagtgttctagtcccatggggcttcatttggagaatgcgattagtacttatattttttaggtttcaaccttttgcgtagggtgggaatggggtgtgcaagcaatccgggtggattgagtgctaggcaaaattactaattagggggtgtttagacgagaacactaataggcgatcagtcgcgcgcctcctctcccgcgcgactggacacgtggcacgtggagatgggcgcgggcggcggcgcggttttccttttttttttggttttcttttttcccgcacgttcctctttttttgtttgttctgtttttttttccgcggtttttttttcacacggtttcttttttttcggtttccttttttcccgcccgttccttttttgtttgttatgttttttccacggttttttttcgcacgttttttttctatccgtattttttttcagttttttcggttttttaatatgtatgtatgcaaagtttgtatacacgtatgcaatgtttgtatacatgtataaaaaagatacggatagaaagtttgtatatatacgtatccaaagtttgtatacacgtatgcaaagtttgtatacacgtatgcaaaacaaactttctatatatacgtatataaagttggtatattttgtatacatacatatataaactttatatacgatatatacaaacttagtatttatatacatcgtatacagattttatatttgtgtatatgtttattatacatataaaaaaatatacatatacaaaatatatacacatatatatacactttgtatatgtatataaagtatatacatatgtatgcattgtagatgagagagactagaaggccataactgaccgcgcgccgcgcgcgactgattgccgatcagccaggcccggtgtttacatccaggggtgtaaagttagttttgctgtgtcacatcgggtattaaatagggtgtcgcatatggtgttcgaacactaataaaaaaaactaattacagaatccatcattaaaccgcgtgatgaatttattaagcataattaatccatcattagcaaatgtttactgtagtatcatattattaaattatagagtaattatggttaaaagatttgtcgatgttacagggcgaaaattttggggtgggatcagggccttacccagttaccctcgccatttttgtgcgtatccctcctcgtcagtttgcccttgtccaccgcctccgcctccgcctccgccgatccccatccatcccgcgagcgagcagggacgccgtcgttagtcctgctgcttccgccgcatccatcctggtgagcacatcctccgcaccgccgcctgcgccgatccccatccatcgtgtgtaattgttcctaagaagaaggaaatcgtcgttcagtgcagtgcggtgcctcgaggatatttccctgttccctcggtgttgactcctcgtgaattcgcccgccgcctgtgccgccgccgatcaccatccatcccacgggcaagcaggggcgccgtcaccgcatcctggtgagcatccatccgctacgcacatcctctttctcatccctctttacccacgctttctcgaatttgtgttaccatagcttctcttctagaaatttgcattaaccttaattctaagaacagtctgtttgctcccaaaaagtttgggggttcaactgaaccccaatgtcccatgttagatccacccctagctcatgttctgggcagacatgaatctctgaatctcctccaggaccttatttgtatggtgggtcaggcgatcaaaatcagtcacctgagctcgaagcatcaacgggagctctaatccatcacattaatccaataagccggcagcactcatcaactgtcattgaagcctaccttaattgtcttgtactgccatagggaccacgttagcccgaagccctcttgttgttctgtagagctatacctcaccagccaccactactggcatgttgaagcttcccgccgaagcaacaatttgatgattaacatctccaatcactctacactttgcatggtttaatttttgtccctcaactccaaactgggtaaaacccatgtccgaactttcaaaattaggtaaacctcgtctcttcacctgttgatagttgttttgatccatgtggctcccacatgggatccgagaatccgagatagtagttgggtctgcttgtcatggagaggttttgacagatataacatccgcattggatgagagtgggagttggtttgattgtcttgaaaaccgtacccccatgtaacatctgcaattccgcattggctgagagtgtcattcatgtaaatattagttgttcacatcttcgactcaacttattatttttctagatttctttttattctttgctgctctgtttcaaacaacaatcaatatatttgatacatagctagaatttttatgtttacaacataataataacagcccgtgcaaatgcacgtgtaggtggttacaatgaactgattgttgactaagtagattgtattaatcgtgaattttagtaggattttgtgttaaatagtatatgcatttgaaaatagaaataacatgtactctttagttttagggggtgtttgggaactagggactaaatttagtccctctcacaaaagtattaagtccctatggtagggacttatgtttttgtgagagggactaaagtttagccccactttagtccctccaaccaaacaccaccttagttttccaaaaataataattctataattcaaagtttactatgaagctatacattggccattgtggactctcattttagtgtgaaaataatttgattcaaaattaaaaaatagcaagtggtaactaatttggattcctctttaagtctaagcatatataatttgaaaagtattcaatatgtttatatatctgcagtaacaacaataaaaacccaatacaacacacaggttggcaactaggagtgttaatgtttctaaactcagcgaaagctacagtaactttatagtaaacattgaagatatgggggaggccaagccattgctcgtctctgcctatctctgtccttggtcctactccaaccatgttggcactgttttgcagaagggaagaggaagatggatcagcaccacgtgcagcagcagcagtatgttgacccttatcggacaatggtgctgtcaccacagcctgaccacctcaatgccctccagtacaatcaccagcagcagccacagccaccaccgcaagcaactccaccaccaccacaacatcaccatgcctcactcgcctcccacttccatctcctccatgtaagtcacagtcctgatctcttaatgcttgtctttgtgtctaataaattgaaggggaaggatgtcatgacaaattttggctgccggagtgccggtagttggtcttccattatctaaaaaaagtctatacacacaaaggttcagctcattctgcagttgcaacttggccatagaagcatcctagaggctgttattcgcttgctatattataattggataacttaagtgcaaattgtctgctgcatcgtctcttgtgaagaaaaaggttgctacaaactatgcattttgctaattacatgtctttcttaagttgacaactgttgtaaatcaagtctgctcgagttatttatgtgtctgcaagagcattagtgtattggctgccacttttctgtgtatttggatgcttacgtgttgcttctgtccttttaggaatatagaacttcactattatgcatgctctacaatgctcagttttccttaattgttactaccttcatcccgaaatataagggatcttttttggacggaggtagtaccaaatactacttacacaggaggtcactatatttgcacacctttatcaattaactctatgaatcatgcaaattattttcttgcctccctgaacttgcttctattcgtatgttaagtcattattgagataactaacagaatgtggtgatctggtcagcaccagtggatggtgtcagtacatactccaatgtggaagagtacttttagggcagtggtggagctggaaccatattgagggtggtgccctactttactatatagatggcagcaattactctaaataatggtatttgttcatttgtagataactattgacacaaaaaatcattgagtagcaagtaaaagtgcttaccgaaatataagatgaaaagaaaccgcaaaggggaacatcaaaaaatacataaaagacgatcaatttatgcaaaatacatcctcggcctcaaagctgtcaatctcaatatcatcgataggtaatagcctacaataaaagcagaacagaagttagaaacatattaatttcaactaaaaatttatatccaatgaacatgtaaaaatataaaaataaatgtgttaccttttagtatactcgtgttctcatgttcataaaacggtcaactacagctttgttggttactcttctcatttcttctttctccacatagcaaataagactatgacttaagtagtcatcacccaactattgtcatcttgttctgaacaagaatttcgtacagctacattattggaactatcgggcgctttcctcttgagatacttgtccataacctgtcaattaaatagttttattatgttagacttacactgcacaatagaacaatgtatacccccaaaacaattaagcaatgatggtgtcacagtatgcttacaattttactaagtgatggttgatggactgatggctacaggacaataggactacttgtcccttctagagatcaattgaaactttcagttcttcaaactttaaaccctaccttatataaatctggatattgacagggtgctatcaacaagttacaaatgaaactaatatgattaaaaataagactagaactagaagagaggataaattgaaagtttggaactaattaaaaggaagataatacatctcttaatttagtctcttgcttgtgcactgctgactgctcggctgctggctgctggctgcaggctgcccctgtagtctggctgctcgctgccgcagtgccgctgtaatgctgccggcggccggctagggcgaccagcaccaggccaggacggcgagcaatggcgagtcggcgaccaacggctgagcatgagcagcaggagtagacggcgactcggcgagcagtggcgagacgaacagacacacagccgcgcagatgctgtattgtggtttggaaaaagaaagaaaagaaaaagcaaaaaacgggagtcgaggaggtgtgcggtgccggcgtggctgtgattgacgctcgaggcgtcgtctcgcttccagtagcccagacggtgcactgttttcatgggccttaggccttccacgacttgcttatgggccaggggtggtgcacgaatttgggccaaggggttcccatgtggtgaaaataagggggtaagtactaaatctgaaaattgggccgggtgcctgggaacccccctaggcccattgggctccgcccctgttttaggggtctatttattaaataataagttatcaaaaaggactagaaattcctgcactgttaaattaagcaataggtgaataggataagaggcaacaatgtagtaattggctgggagagggacaacagctgccattctgccacaagtggagtagatggactaaggggctgcttggttggcggcttggaatgccacgccacggcgtggctcgccacaggagtgtggcggacgtttcgtcgcctcagaaaacactgtagcgtggcgaaaatactgtagctatggcattcaatggctgggatccaaacacaccctaagatgtgaataattaaatatggatgctaattttagtcaggtgggtgaaattctgaaaaggagatttgctacaatcaacgaatgaaataccggtgtgttttttttaacattaaaaagctatttttgagctgcttttggaatttaacatgtggcagtgtaaatgatgattgcttgttatggaatatccgccaagcacatctacacaatggcgtatatctaattttcttatttcatttacaagaaagtactacctttacaaatcaatggttttttatttgtttatcagttgacgacaagattagctgatgctattggaaagggcacaagggatcaaaattctgatgcactggtaagaaattcatgcagctcttaatagtgttttaataaattgatgtgattctactccatgatgcatgattcttgttgtaaagaatgacattaatttctctttggagtgtacatattcttggaaagtttattgtgtaggaactatttttcagttgttttgcttcataaacttattatgaaaccacttcctgttgtaatataatatggaggaaatgtatggaatatgctaggtgactgattcttaccatataatattttctactgagagcgatgaatctgaaagacaatatgccaatgttgtcacattgttgctgtgtcatatgccgtcctggtgatgggtggcacttgcctggggtcctcatctaggatgagagctagagggagggagctgagtttatctgtttatgtgttgcgctactcctttcctttttatattttatttccgtagcattgctatggcctgacctggatgccaccctggctctgtgggcttacggtgccttgccagagcaccgtgacaacatcaatatacttgaattatattattataaactacatattttttatagttaatatgtacactgaactgggattaatgctctctgcgatctgtttccacactctttattgatgctatcaaactttccagttagtaaacctgcgtattttgtatctcatatgtgcctgtgcaaaattgtataactttccagtttccactatcctgttattgttgtactgcttataatgttatagcatgaatatctgagtaattagatggtctttttatatgtttgtgtaggttgaagatttgaccagtcaatttgctaggtgtcaacaactattaaactccatatcgggaacactaagctcgaaatctatagtaagttttgttacatctaatgaggtatttggcttgttaaatttgctatgcgatctgatcacatagtaatagatatcgttaaatcttctttgttgtagctaggctgtaattcaaatacatggtaacaaataacagcgtgatagaaatctggtatgtcccatccttggaaatcagtaatctgccgagtgccaacgtacacatcagatctagttcttgtgattttttgtctgaattgttgtcttgcctttcgtatttatgtggtgaattgcttgtttatatgttcattgcatggatgatcacttattcgaaccaaacgatggaaagggtttccattccattccttgattcagccagacaaagtcggcattttgcttaatccatttcagtttccagtgtttctaagttccaacactacctatatgactcctgttgcacgaagaccgtaagagtgaggagatacaaaatctaagaatcacgtaatggcatttcaaagttttgtagcattgaagcatggtaggcaggaaatattctaatactatgctcatgattcatcaattgacaagcattatatgaaatgacccttcgattataggtggagtaattttactaaacaagaataactaatttgtaagtagttgggcatacagttagctgttctgactaatatctaatacatagctcaatgtttgttttcatgaaaaaagatggtgactgagatgataataattctaatagatggtccggtaataaaatattttttgaaatctagcggccattttggtttgctaccaaaatgtgccctacgaattcatttggcaactttaatagtgctttgatattgtttggattgaagccaatttatagctaaatcaatgtgatattataccaaattgttggtagtaccaaaacttgcaaagaaccaaatgttggcgatatggcatgagacccttcgaccaaacctgccgaaagcatgcgaccaatggggattaaagcccgagacgtcagggttagtcaaggcgaacccccccatggcgaagactatggagcaaggatggcgagaggcagggaatcgcagccaagctagaggcctcctgggcgaaggacgcaaggcgaagagcatatgccgaagggggacgacttcgccgtagcaggttcggccccgggagggccgaagaaactatcctggcccatcaagcctaggggtcaattgggtcgccaataacccgtcggcccgctaagggcccatggactgcaattacgctatgtacccatgtaaatgtccctttcataagggcaaccatgtaaattcccctgcataacgaaagccctagtagtaagacctgtaatgggggctataaatagccccatagggccatgtaatggggggatcccaagtaaaaattctcaaattaatacactttacttcttttccaaccactgttgagtgaccacgtctttcgacgtatgcggttgtcgtttcgacaacagctggcgccgactgtggggacctccgagcgaaaccactgagagcgaatgccaccgaaggtcgtgaaggagaaggttacaagacgaaaggaaagcgaagccggggcggatatggccggcgaagagggagcagagccttcggcgctcgtcgccgaagatggaggagcgccatctgcttccgcacctgcgccatcactaccgccttcagcccctgccacctctgcacaggtgccgaatgcggctgacatggcgaaggcggctgcggcggcaaggtcactccagaccagggcggagatcctttcgacaagccaactgctggtgccccaagccgctccgtcgcagccggcagcggccccaactgcgctcgccgccgtgcaagcccaagtcaaccctgatcccgaaacacaaaccgaagccgacatggaagccatgcgacagaacatgacacgactccaagacatacttcgccaaatgcaagaacagcagcaggcatacgaggcggcaaggcggtccaaggtcacttcggccccaatcctccagtattcggcaggctatgtcccaccccaagtttatccacaagtaccgacccaaccctttccgccacaagttgtgcaagcgccaatgtacttcgctgggcagccatcgaccgcagcagcgcatccggcccctcacgtgcaactgcaagctcaaccggtcgctgcccaagtacaccctcaactgcctggccaagtgccacaaacaatggcagaaggggcttcggctctgcaggcacagctccaagctttccttcagcagctcagccaaccccacaacatttcaggtacagccccttcggctcacccggaggggaatacaagtcaaggtgcgcctagttggttgccgtcgaatcagctaggtctgggggcttcaccgtggagtcaaagaccgcagttcgacttcatcaatgctgcttaggcaccaaccgtttggccgcaagcaccaacgccaggcttcggagcaaaccgagcaccaaaccaggtcgctatgacatggtcagagccaactttcgacccatccatgacagctcagcaagcatcaccaatcggagccgggcaaccgaatgccatggcccaacctcacgcgcaagccgtgatttcgcccttcgcctcgccgtaaccgcagcaaggtgccgtgaatagggcagggggcgaaaaggggctaccgctaagtgggggaatcaagacccgtccaatcccaccccagttcaagttcccacccgtcccacgctactcaggcgaaactgacccaaaggaattcctctccatttatgagtccgcgatcgaagcggctcatggcgacgaaaataccaaagcaaaggtaatacatctcgctctagacggcatcgcccgttcttggtatttcaatttgccagccaatagcatttactcatgccagccaataccaaagccaatagcattgtccttaactttcgaggcacctatgaggagccgaagacgcagcagcatctactcagcattcgccagaggccgggggagtcgataagggagtacatgcgtcgcttctcgcaagcccggtgccaagttcaagacataaccgaggcgtctgtcataaacgccgcttcggccggtctacttgagggcgaactcacaagaaaaatcgccaacaaggaaccacagacgcttgagcacctacttcgcatcattgacgggtacgcaaggggcgaagaggattccaagcgacggcaagcaatacaagctgagtatgataaggctttcgtcgccgctgcccaagcccaagcacaagttcaagttgccgaaccacctcctctcgctgttcgccagcctcagccggcgatccaaggacaaccgccaagacaaggtcaagcccccatgacctggaggaagttcagaaccgaccgtgcgggcaaggctgtgatggctgtcgaagaagtgcaagccctccgcaaggagttcgacgcccagcaagcaagcaaccatcagcagcctgtccgcaaggtccgaaaagacctctactgcgccttccacggacgctcttcgcacaccacggagcaatgccgaaacattcggcaacgtggcaacgtgcaagatccaaggctgcagcagggagcagctgttgaagcacctcgtgaagcagctcaagaacaagcacccctggccgaacagcgccaagatgcgcagcgcagagtaatccaagtgattacaagggccgacccaccgatccagctgtcgaagcgacaaaagaagatgcagctacgaacggtccacaatatcacttcggcaggcgaaggggccccgcagtatctgaatcagcaaatctcttttgggccaggagacgtcgaaggagtaatgttcccgcatcaagatcctttggtgatctcggccgagatagctggtttcgaggtccggcgaatcctggttgacggagggagttcggccgatgtcatcttcgccgaagcatatgccaagatggggttgcccaccctagcccttaccccggcgctagcctcgctccgtggttttggcggagaagcagttcaagtacttggccaagcacagttgttggtaactttcggcgcaggggaaaacagacgcgaagagcaagtattgttcgacgttgtcaacatcccttacaactacaacgccatcttcggccgtgcaaccctgaacaagttcgaagctatttcccaccacaattatcttaagctcaaggtgcccggctcggtgggagtgatcgtggtcaaggggcttcagccttcggccgcttcaaaaggcgatcttgccataatcaacagaacagtacataatgttgaggccgaaccacatggctgggcgaagcacgcgccaaagcctgcccctcacggcaagataatcaagatgcagattgatgacgccgatcccacaaagctcgtatcgctggggggcgacatgggcgaagaagtggcggcaagcatccaagaagtactcaagaaaaatagtgatatcttcgcctggggccccgatcaggtgggaggtgtttcgacagacctcatcatgcatcacctagcagttaagccggatgccaagccaaggaaacagaagctgcgcaagatgtccgttgatcgccaagaagcagcaaaacccgaagtccaaaaattgctcaaggctggggtcattcaagagatcgaccatcctgagtggctggcgaatccagtgctggttcggaagtcaaacggcaaatggcgcatgtgtatcgatttcatagacctaaacaaagcatatccgaaggacgatttccccctgccacggatcgaccagctcgtggattcaacagctggctgcgaactcatgagctttcaagatgcatattccggctatcaccagatccacatgaacccggccgacatccccaagacagccttcatcacaccattcggcacgttttgtcacctcaggatgcctttcggcctaaggaatgtcggagcaaccttcgccaggctggtgtataaggtcctttacaagtagttggggcgaaatgtggagtcttatgtcgatgatatcgtcgtaaaaagccgcaaggctttcgaccacgcgtccgacctacaggagaccttcgacaacttgcgcgcagcgggtatgaaactgaatcctgagaagtgcgttttcggcgttcgcgcaggcaagttgttaggcttccttgtttctgaaagaggcattgaggcgaatcccgagaaaatcgatgccattctgcaaatgaagcccccgtcgagcgtacgtgaagtacaaaagctcgcaggccgaattgcggcactcagtcgattcctctcaaaggcagccgaaagaggtttgcccttcttcaagaccctccggggcgcgggaaaattcaactggacacctgaatgccaagcagcgttcgacgagctaaagcaatacctgcaaagcccgccaactttgattagcccagcaccaggaagcgaactgctactatacctagcagcttcgccagtggcagtcagtgctgcccttgtccaagaaacagattcaggccagaaaccggtctatttcgtctccgaagcattgcaaggagcgaagacaagatacattgagatggaaaagctcgcttacgccctggtaatggcttcgcgcaagcttaagcattactttcaggcccacaaagtcatagtgccatcgcagtaccctttgggcgaaatactccggggcaaagaagttactggccggcttagcaagtgggcagcagagctatcccctttcgacttacattttgttgcccgaactgctgtcaagtcccaagtgctagctgactttgtggccgaatggacaccggcactggcccccgagcccgaacccgtcgaacagccctgggtgatgcattccgacggttcgtggtcgcacaagggggcgggcattgcggcagtactcacttcgccaagtggtgtgccgattcagtatgccacaaggctgcagttcgacataaccaacaacgcaacagaatacgaagccattcttctgggcctaagaaaggcgaaagcaatggggattcggcgcctgctaatccgaaccgactctaagctggtggcgggccatatcgacaagtcctttgaggcaaaagaagaagggatgaagaggtatttggaggccgttcggtctatggaaaagtgcttcaccggcataacagtcgaacttttacctaaacctaatcaccggtttcgcggctgtgctggagatcgccaagagggtgttcgctacgacgatatcttgcagtcgcgtaggcgaaacatgagagcctgccccggatttcgcaggggtagggctgggggtataaccatgagagccatcctcctcagaaccggcctccgcatcctcctcttcctcctccccatcactttcgacggcggccttcgcgctacggcgagttcggacttggccgcctttcgcgaccgcacgtttgcgttttttcaaagtgccagcctcgtcatcgccggcccgagaggggttcgatcggcttggcaatttgccggtatagacacggttcactcggccgtcaacatggcgctggagcaagcgggcgaactcggctgtggttagagctccgatcatcttcgacgcctcaatctcagcgtcttccaaagtccgcactgcgaaaagagaggaacacaaccgtttagccaaaaaagcgcttccacgaaggaagtatgcggcctaagtcgaaaacaaaaaccttactttcgaccccggcggggagaacaaggcggggaagcccaagaacttcttcgccctcgttcacagaaacgtcccacacacgggcgagagggaaatccgaaggagacaaaactcctcgcaaagatcccgggtgctcagccgccgggcaaccttgcgaaggagaatgagtcgggactcaagagtcccgtcgatctccacgtttggcttcgcgttgatgcagacggcagaacgctcaaaaagcagccagtttgcctgagtattttcggtggagtaggggttgctgatatagaaccatttctgcatccagttcctgtcccatttcgccatcgatgcaggcactggccaagcatctgaacgctccggccgcagcatgaagttcacgcagccgaaaacggttttcctcggacccgccggcgtttgcacgtctttggtcgaggcgcatgcagtaatcagagcggcgaatagcttggcggtaggggcgaacccacaggtccggcacatccaagcgaaaaccgccatcttcgggaacgctgacgggctaagttggggaagcctaacgtcatacatcgaaagcaccgaaggcaagaagttgtcgcatgggaggcgaagcccagcagcgaagtatgcggcgaagacaaccggtcgcccatccccaggcgagggaacaacagccttgcccccacacgatccttggccctctatgagaagaccggatgataccagttcgcccaagtcggcctctttgacaagagatttgccaaggaagcacgaccatccttcgccaaggcttccaggatcttcgccagttgacccggccttggtaggcttgcggggagccattaggcttgtagcataggaaagagaggtaaaaagccgaaaggctaggagcacgacgatggcgaaaaagctaaaaaacaggagagcgaagagagcacggagcgtgtaaagcggtaaaaaggggaagagcacggggagagtgaaaaatggcaggccggtttgggggcatatataaccctgtagtgagaccgttcgcctgccaaccaatcgagctctgacacgtgtcaaagggcagacgaaacggtaaattcccatcgggacggtgctgaacagtaaaaagcccgattacggagaaggaaaaacccaaagggcctattactattcatagtaataaaagagactaaataagcccccatcgacgctttgcaacgaacgtgaagaggagatttttctgaaagaaattttttgtaaacgtagaaacaaacaaactttacttgtaggaacaatataggtttcgacaggagcaccggtcgaaagggggcgccacataccataccacatggtttgcacggtctcggccgaagctcctatctcacccttgcccgtgaggggcttgttggcgatatggcatgaggcccttcgaccaaacctgccgaaagcatgcgaccgatggggattcaagcccgagacgtcagggttagtcaaggcgaacccccccccccctggcgaagactatggagcaaggacggcgagaggcagggaatcgcagccaagctagaggcctcatgggcgaaggactcaaggcgaagagcatatgccaaagggggacgacttcgccgtagcaggtttggccccgggagggccaaagaagctatcctggcccatcaaacctagaggtcaattgggtcgacaataacccgtcggcccgctaagggcccatggaccgcaattacgctatgtacccatgtaaatgtccctttcataagggcaaccatgtaaattcccctgcataaccaaagccctagtagtaagacctgtaatgggggctataaatagcccctagggccatgtaatggggggatcccaagtaaaattctcaaattaatacactttacttcttttccaaccactgttgagtgaccacgtcttttgacgtatgcggttgtcgtttcgacaacaccaaacaagccctaaattaggttatctacccccattatagttattcttgaatcagggttgatattaagaccttgtgattactgtgattacaagatatatcataatgttaagagaatttcttcagcatccctgaatattaccaaaaattcagagctttccttcacttcaactgatttttttttatttctctggcctgccattgagaatttaagctttcgtttaatgccatttgatagcttgttcctaactttatgtattcctcccattaactttattggaggattgatttttccctttttctgcaatgggtgaaactagcctgcatattgtgttaggtaatagggccaatgtataatcgtcttccttctctctctctctctctctctctctctcttccttctgtgtgtgtgcgtgtgcgcgcgcgcatgagcgcatgccagtgtgagggggagggatgctaaaggaggtcaaagtggccaaaaggacacgtccacaccccactaaattatagctgcaatctggagcagaagaggggggaagaatgtgaagaaaagggagaggagaagatagatgccagagtagggtgctcagagctcaaagtggctgacaaggtattggtttctactgtatgccacacctgcctgtgatgcagagcagaagggaggggatggataggggaggataagtgagaaataagggtaaggtgcaggaggataggctaggcaatagatgtagtgaatgcaatgtacagacagatggctggacgtaaagaaggtaaaggctagatctaggaggtgagcttgtttcagtggagatgggatcagtttctaagggaaaatggtcacacttgacattgctactacaacatgatggaatggtatcactcgacaaaacgtgaacactggatggtaactaattgtatcaatgaacttcactgttataaagctaaagtcactgttacaataccaaatttacaaaagaaatattaactgtcagtataaaattgttatttttagctcatttttccctgttagaggtttatgctcagtcttaatgtgagtccactaaaatcttggctggtttttactttgtttactaataaccaagagaaacagtaaatgagcaacaatttgaccataaaattttcaaatattttttgcagataaacctagatgcctttgtaagaaattaaaataggacatttatgtattttgtgaaaatcttgacatgtgctacttaacttctttctgagaggaaagaaccagtgttgagcaagcctactcatggcaattgtttctttttcttaccaatagacagttgaaggacaaaggaaaagtttggaagaaacgcagcagctccttgatcagaggaagtaagacaaccattcggtgaaccaagctctggatatttatttatttggtactgaccagcgtttaacctgacagggatttgatcacaaagtacagaagctccgttgaagacctgctcaagggggatacaagaagatagtaacatggtgactgtatggtagagttggaatgttaaagaggagctcgttgctacatgtgatcgttttctaatcagcatcggctacttttgtaatcgaggtagccttgaagttggtctggcttaggaacatactttcagtttgtgctatctcatattgttggtgggtaatgggttcatgggtttctgagacgagcatgctgcccagcttatattgaaggtttactgaggaccagtcattttgtttaatgggtaaatttgatccatgccattgcaaactcattgtattggaaaattgccattagtatttatctatttggaatttcacgcttattcgatatatgccgctacttaccccttcaagatacattctaaaaattttggactgaattgtccgttttcttcattcatcccctcctctcctgttcggagatattagaatcttatgaatatgagagatcctatcaggtatcttagtaacttgcaatcttatgatcttgctaggctgaaacgatatcgatcttattaaggtatagtttcatagtattctaatattatgcgagagatctatatgattccatgagattggtaggatatatgtttcgattggtggtattatttaaattaaggcggatttgaaagtaatgtgtataggctttaatttttataatgtattacatctcttttgataggatcctgatcctaagatacagtaagtcaaaaaatgatcttatctgaatcttcctacgtgaaattcatttctttgaaacaaaatgattcgtcttcattaaacctcacatagaaaagtttccagatcacagccaaagagcccacaagcaatacaacatttgaaaattaatgacgcaagagtatgactttttttcttgttatcacggagtaatttgggtttgataatgcgtcaccaagttcaagagaaaatgacctatgactatgagagcaagtacaaaaggttgagtcagccaaatgcaatattgtcaacgtcaaaatcctacacgaagaaaagggaagggagagagagagcaaagcagatgctcatgcagaatagctctgagaaaagatgcagtatcgtttgcatgggaatcctctgacatccgatagctctagtaacttcattcggcatcggacggagtcaagctagaacagcggatagcctcagcacatctataaaattatattctaagctcaacatgcaaacatgccaccttatcatccacatgcatgcaacatcatctgtaattcgttgaattctataaatcaacatccaatcatcttccttcacaatattttcacaatatttttaacacacacatacacaaacacatcatttttataataattaacatatattcgtccatataatcaaagtacgggaatatcatatttcatctacaatctcatacagagtctactaaatatatttcttctctttgaacatggtttgacaaaccatttttatttgttgggcctgttaggtaagctggttgcagtggctgcggctgcgctgcagcacatgcagccgaacaggcccgttgttaataactaatattatttttacttttagctcgattattaaaaaatattaaaagttagttaggaatttccacagcaaagcgtggggaatcaccacagcaaagcgcgggaatcacccagtatgacacaaaatcatccacaaccatcgatgccacctctgagccacagccactggcgcggtggcgccgctaggaagaaactgggggagaggggaaggcctctgcgccgtcgcagactccatcaccaccgccacagcttgcgcctccccggcgaggcccccttcattgctgcgctcttcctggccagcaaaatcgagatggctcctgattacccatggtcttcggccgctcgccgtctcctacggcgcatgtgcgggtggagctgatccccgaagatgcaatttatccaaagcaacgatgcattgttatgacttgtgagattttgcattgttgtgacttgtgagatttattgttaagagcatcctgagtgctgcaatttcgtcacagatttgatccaagtctgtattcatgtcagttgtctcaaattgcagcactacatgatgtatatgtgtacaccttttatttttatttttttgccattttgcaagcaaacattagagtatgtgaccaaatctataaagaaatgctaggtgggtggtctacttgattcttaactgttatcagataatcaggtcaggtcaggtggtctacttgattcttaactgttattctcatttgcacagaaagttcataaagaaatgcatagtacagaaaggcagattatatcagataatcagagttggggtgggttggaatattaggcttggtccacacagctagagacttcctaccataagcgcatttcaccttttcctgcaattggagatttggatcaagaacaaagcgaatatatcagaatgcaagctatgaatcgagttagttaattgtttgctgaacagtagaaactatacttggtagatttttataattgctactttaagggggaataaaagaaactctatcctgttttcgattgttttgacatgcggtttgatcttttcttagcagttaccgacttactgtaatcaagcgaactctccgatgagaactttggatgagctgtaatgttgccaaagcaattctttccatgtttttccctcaagcctggagagatgacagatgttgtcatcagatgggcctctctcaggttggcccattgatatttcctattggttggcccattacgcggcttcttttctagtataatctatacatatccagtagaagatgctatattttaaccagcaaagttgctatattttagggacagaggtaatagctagcagggtggcactattcaacctttagcatttgacggcgatgctatgcactacagcagatgccaatggcagaaatccaagaaccggtgtatgtatatgcactggtgtctggtgccaataaacaaatctctttcaaccgccaacaacttattgaattagtagctccattttccatataatgttttctagggaagacaccatttactttcaaagcagtacagtacatagagagtgggaaggaaaactttcaaaaccagggtctagattaatatattaggctgcagccataaaaacaccatcatttgtatccctgacaacaatcccacacccaccagaatctgcatcttgtagaaaaataagtcatcacagtttacctttaaaatgggaggcaaatttgcattttcagctcatttcacctttagcctactctttcctcagtttctccacagcaaaacactaatcaagacaacaaaagttagtaatctgaagttgataaaaaacaaataaaattagtagcacctttagcataccttatagttgtattttgtgttacaaacctagcagatatctcaggtccaacaagagtggtcatttgtgccctgtccacgctggcaggcacatgtgacgctctaaggtgccaaaagtggcaaaaaaaaattagaaaagcttctctccaattaataatcgatccaaaaaggattcaatgattagcacacaatatattctatcaataaaagttatggcaggatgtctaaatgcttagcacatagagaagcctaacaagtacatacagtttcagatgtccttttgagaccaattgcaagagctccgtcataacatcattgaacaaacttgagagaaataaatctgctggttacctgcaacgttgaaatgacataacaaaatattatgatatgaagtcagaaaattattataaatataattgatgagctgaagcgctagaagagactatcatttgctatccattctgtaagacatcgagggaagtagtttgcaaacaaacatataagtaacacaatgaagggcaaaggttgtgtctcaaataaattaagtatgcataaaagaatatcactaatccatgaaataacaaaatgcaaaaaaaatttgtagacagtgaccagcagaagccatattccaagggtgagcaacagatacagcaccagccacaggagtaccctcaccttattctctgtgacacataacctaaaaggataacagataagaaatacaaaatgaaaattgcagttcaattattcaataccaactgcagtaaatagcaaattgcatgcacgtgaggagattatggaaaataaaacaagaatattggcacctatgcttaccctaacagcaaacaagggagcctgtggatacttctaatgaaggtaattggaaaaccacatggatatcttctgtccatccagcacagtagaaacaatcatactgcaaggataaatagtttgaggaacaagcaccagttgaacatgtttcagcaattgctaccaaacatgcaattctgtgacatcttttttcctggtgcaagattctgtatttgagggtttgctaatttccacatgctccatcattgatttaggcttaactccacttctcccatttccactctcgtgaagggatccaagtttcaaccaggggatctggacccatggttagaaatcataataaaaaatagggttaatttgatccatgccattacaaatatgcagtgacttgccattcgctatcagtcctaacatttaccatgtaagacatgattcagtttcaaaagaacaaacatgaattactcagccacacagtgcaagggatcacaaaaaaataacaaataaatttaaatgatgttacaaagatactctccaccatattcagtttgctctcctagaaaccaccatattaattctaggggacaaaaagctgaattcctacattaattaaaaaattagaaattctcactgtaatcagtaaaaagaatagatcatatatgtcgaattttctcacatgtgaatcctacagcctctattaagcaatgcaaaggaagagattgttttccgcatagaagttaaaattgaaataaatagttgtccgtgcaaattaacattacacaaaatttgcttgctcgtgcaatgaataggttgattatataactaactgcctagtcaatcacttaattaatactccagtttttaatagatgatgctattgacttttagacatacgtctgaccattcgttttttggcaaatgcctttttgaaacttctatctgtagttcattttttggcaaatgttatcatcttttgcatctctagacattggtttacacaattacgtttaataaaagcaatgtcagttaaagcagatgaatcttcaactttctaatgccatatatcattaaaagatttgcctatgaagaaacttgcagttgtggaagagactgctacatcatgtttggaacaagttcagaaggtaggcaaacatttaaaatggattttatggcaaatttctagatcttatttattaaaccaaatttggtagcgcaatcatagggacttacagaagcagtaaaatcactagttaatccagtcatcacaacaagaggtgttgaatcatccccagaaaggactacatctcaaaagccaatatctgcttctgcaacatagaactaaatcatcaggcatctcttgctagcctatcaatctgaagcaatcaaaaatcatcagcaccttcacaatcagaagctagtaactaatgtaaagcaatggttccaccatcacaaaccatgtacggttgcccatgttacagaaaattcaacaaatatgataaactaacaaaaactatagctgcagcatcgttctagctttatctcatggtgtccaaactaaacagaacatgaatctctgccatatagtaaatttaagtcagttaggtttctgaagtaaactcacacaaaggcagtataggagtttccttttcaaatattggctgctcaacagaagactaacagtatcatcagtttaatcattccagtaaagtggcattaaaattaatgccgatgttcatcaaaattaatcttaaattcttaatacaagacttcgtctcattcctttgctcctcaatgataaaaaaatttaaatgcaacgaacaaattaaaacaatcaagatatcctcacaaccatcttgttcttctttccagcagatagcaacagcactttcccatcaactacatcaccttcctcaaccaacttatcctcgctatcaattcttatgttatttaagtatagccccccttgcttaataagccgcctaaccgctgatttgctagcaagcaaacctgtggagactgctagatcaaccaggggagacttcaaaacttggccatatggcaaaaagcatgatggtacgtcatctgctatcccctcaattgtttgtgaatccaactgagtctgtgccccaggccgtaaggcttccgtggctttcaacgcttcctccaatccctcctcaccatgcacaaaacgtgtgacctcttctgcaagcctcctctgaattgtgttcggcacatagccaggcttcttcatcgactcttccagctcctgaatctcatccaggctcatgaatgtcagtatcttcataaaccttatgacatcaatatctggcactgagaagaagtactgatagaatttgtatggtgacaacatcttgggcgaaagccagattgctccatcctccgtcttgccaaacttcgtcccatcactcttcagcagtagtgggaatgtcaggccgtgtgccccctcaacctgtaaaatcttccgaattaactcagtccccgctggatgtttccccactgatcacttcctccaatctgcacattaacacccatattgcggaacatgtacaggaagtcatagccctgcaannnnnnnnnnnnnnactcagtgtagctcattccgtcctcggacataagccgcttcttgacactctccttggctatcatcgtcccaacacgagcgaatctccccacctccttgaggaaatccagcagcgtgatgtccttccaccagtcatagttatcaaggatctgaaaagaacccatcttttctcccgaattgaccaaagcctgctcattttgctccaagttcaagtttttaccggattgcgaatgttgggagggctcgggtgcacggtcaaggatctggccgatgagcgatttgatagcgttggagttggtctcgacggcggcgaggtcgagctcgggccgctcggcgctctttccagaggggtcaccgacacggccggtggcgccgccgacgagcgcgacggcgttgtgaccgcagcggcggaaccaggagagcacgacgagcccgaggaggttcccgaggtggaggctctccgccgtggggtcgaagccgcagtacgccttgagctccctagggctcgctgaagccgaccccagagactcagaagtggtggcctccacgagcccccgctcccggagcacctccactacgctgcgccggataaccgtggatgcggcggcggcaccggccggggcggcgctggcggagaggctgcggctctggcggaggaggagacggcaacggtgagggcggaggaaggttcgcaacgaggcagccatagcgatggaagccatcgcccaagggagaaacggattaggaggaaatttgctgtgcgcccccgcccccctcttccctggtgatagggtttccgtaccaccccaccccctagtcaatacaaagggattgtttagagcatcgggagctcatccaaatatcatccttcatatgtccatatggatagctatttaaaaaagattcctcattcatatctctttctactctaacaaatcatccatatcacatcctcctatattttattaatatcttccaactaatcttatacttttaagagatatattttgaacgactaaatgctaacggtattatttatcgcgataaaatttcgaaataaataatttttaagagatataattttaacgggtaattttttaattgatatatttgatctgagtgaatcatagcaagaaaaatcataccaatacaaataaaatgaacatactagtactatctctactcagattcttttctctgcttgaacatactagtactatctctgctcagtattctctactcttctctactactactactactattttctcatagctagtgagggcaacggcgggcgagcgggggcggtggggcggtggcaggcgggcgggcaagaggagcagatgggcggggaggaggcagactgcgacgggcggacgggcgaggcgtgggcaaggcgccgtcgggcggggaagcagcagcagtggccggtgggcgcggaaccgcgcaggcgaggcggtggatgcttacacgggcgggtggcgtaggcggccggcgggcggggaagcggcggcggtggtcggtgggagcgaagccacgcaagcgagtggcgtaggcggccggtggttgcggtgccgcgcaggcgacggcggcggttgctaaggtgggcaggtggcgcaggtgggggcgggatcaggagcggcagcagctgctgcaggcgggcgcagaagcggcgtcggcggccggcgagcaacgacgacgacggagggtacgttgatccggaaatcccgatgagggcgggagcaagaacgttgaggtatggcgtgaggagagtgaattgctatatttggccgaactctctccgatttggtgcaacgtctattttttggaggcctcgatgccgtatctgttggagggacaatttcttatcccatgcgctatatttcgaatggagtaccggatagaggatctgctagggatttttttttccacatcgaatctttcgacacatgcatagagcattaaatataaatataaaaaaactaattgcatagtttgcatggaaatcgcgagacaaatcttttaagcctaattagtccatgattagccataaagtgttacagtaaccccacgtgtgctaatgatggattaattaggcttaataaattcatctcgcggtttccagcctagttatgaaattagttttttcattcgtgtccgtaaacctcttccgacatccggtcaaacgtccgatgtgacatccaaaaattttcttttcacgaactaaacacacccaaaggagaaacacaacaaatcacacgatatctattatctatatgtctatttttatctctactattataaaaattgaagatgtttttgccgatacttttggtacgtcatccgtgtttgaatcggtttttaagttcaatcgcttttggaaatacagatccgtgtttgagtcggtttttaactttgtttgtttttagaaatacagaagaagtcatataagaaatctctttaaaaacttgcatgttaacttgagacgaccggacctctaattgcagctcatgattttgtaaaaagaatatccaagcgaattcccacggtgaatttcaccttagctaaaccgtacaacaataataatattaaaacgttgcaacgcacgggtattttttctagtctatactagtataaaaaggagtagttcagtttaccccttccaattcaataggttaaatcagggcctgtttagttcgcgaaatgaaaattttcgggtgtcacatcggacgtttgaccggatgtcggaaagggtttttggacatgaatgagaaaactaatttcataactcgcctgtaaaccgtgagacgaatcttttgaacctaattaatccgccattagcacatgtggattactgtagcacttatggctaatcatggactaattaggctcaaaagattcgtctcatgatttcctccctaactgtgcaattagtttttcttttaatctatatttaatacttcatacatgtgtccaaagattcgatgtgatgtttttgggaaaaaaattttggaaactaaacatggcctcaatggtgaaatccctacccttcgcctgcccatcacggcgatcgtggttccctgtcggctagcgtcgatggcactcttccttctccccttgatattgccctcgatgtcgtgccacctacactcagatttcgccatccgcaattaaaaccactcggccttctccctcgctcaatctcgctggccgtctctagcaccgtagcccgccagccgcttccatccatgcattcgctactaccgtaacggtctctgccttcccttcgttgctgcggcgccacgccaatcttcgttttccctttcgccgccacaccacgggctcaatcagtcgcccatcccgtgcatacgctgccatccgttgagcctcctctgctacatcgcgccccaagggtcatcaagtcacctccactagccgtcgtgcggggcaagccttgctgccgcacggcatggagtaagtggttttccgtcggagtccttgctgctccgtgattctgccaccagagcattctcgagtccgcatatgacaaaaaatgacggaccaattcgatcgcagttcctcttgacagcgggttagtaatatcaatccattgagtgctaattccattatttcagcttacatgttatgttaatgattattgaaacacgtcctaatttgattactacttcctgacaacatgattggcctcgactggatttgaataatcacccaaggtcagaaagcgactggcctctgcttatttcaatgaacatacagagcactgtatcacaatcgcctgcactaacaggtaaaatacacactgaatagggacattgtgttgttatggatgtattgatgtcttctttttttgccaaaacatttgatttattttatacatatgatttccttcatctgaattgcttcctgtattgtacatagattttcactaatgttatgtatatttttttaatttgctgaactcccaggattaaacttggttactaaatgttatggttcctttaatcacagccaaccaacggatatgcacatatgaggtaaaatttgtcatcggaaagttaataaaattttctttacttttggagaaagtgtaacttgtgggttttgatataccatttgaattgagaaatttttcaaccttcagatgtacctcttccttatatctgatcccattgaatgatagagtgcagtggctaccgatgatgtggctgaacattcatataataggaaaaatcagaacatcattttcttttaggacataaagctcaccactaattgcacatcggcctagaatgtgttggatatggttctgactggatgtagtcccttgataacttcttctacatatggaacatatggaagtaaagaaatggtttaatttttgataatattgctctttttgtttcctcttagagagttctctttaagaatgatctctcccttttagtccataggcttaatttatttgagagagatacacttactaattggattaatatgttgtaattattttccttttattttttttcaatatattaactgtgggggctttccctacagtgttttcccttaaaaaaaaataacttcttctacaatcacatattcttttgaggatgggataattattaggaaaacatagatggtaaaattattgtaataattgccacttagaccggtgctatgcctatgagcatgtgacattatcaaagtttatgcttttgtaggtgtgacagaaacatctgagggccagtttcagggggacatattgccatttcgcattagtttctcattgttgtgtgcatgcataggcaaaggagaagagtgtagggaaacactaatcattccttaaagggatatctccttatttttacatgtcccttaaaaggttatcaaaaaaattgaaaaaaaaatagtaagatagatcaatatgtgatatatcattccgtaaacatgcatattcaaattcaacttatacaattaaaaacaaaaacaacaaatttgacaatgaatagaatgtgtaaatcatggttaaatttgttatttttgttttgaattgtataaatcgaattttaacttacatgttcgtttcaaattatataagtcaaatttttaaaaaagataacttcttctacaattacatcaagatgtgctttgcatttagacaaaaaaatatagatcctaaattagaaacatgcatattcaatttcaacttatacaattagaaacaaaaacaacaaatttgacaatgaacagaatgcgtaaatcgtggttaaatttgttatttttgtttcaaattgtaaaagtcgaattttaacttacatgtttgtggaaaggtatatcatatattgatctatcttaacatttctttttaaaatttgttgatgattttttaaatgaaatgcacaaaatgagagggtgccctctcgagggataaaaatccatctccacgagtggtctttatagtggccaaggacttgctatcgacatgccaaaattcacctttttaacattatcaactcttgttcctgggtgattgggagagaaaacacctcgttttctgtacgcacacttccgaaactactaaacggtgcgttttttaaaaaattttctatagaaaagttgttttaaaaaatcatattaatccattcttaaaatttaaaatagttaatactcaattaatcatgcgttaatggctcaccttattttgcgtatcttctcaatcttctcttttcctctcctctcaaacaatccctccgtggtgtgaaggtaatctcacttgaattagtataggctaccatttacacctgaacattagaaaccggaaatctattgggcaaatacttattttgcgggtgaacatttttttattaaatttcagacttcggtgtgtcctatggtcagaatgcagtaccttttagacttattcattctggattacaaactctggaaaacggttggagatacacagatattacccaacaagaaaaaccaggacattccatttatttctctactcctcctttcatatatatctatgttcgttattcttcaatttctttcatgtagatatttattctaaagcgatgttaatccattaaattatgcatgctacatattaagtcctataccaaactgtggagattatggataccccatatctacatgacagttataatttagtcggatatatggtaccaaatatagatagaatatctctatgaggactcgggttagattctaaacttgtatgtcaagaaaatacccgggatcctagtcggttacgattgtattttatctataatcccatattccgttaggatatggacggtactttgtaaagcgaactccttcccctatataaggagggtccatgtgcctctcggggcgcgattcttttttccaatttatacaatcaataacacactcggcggaatcatccccggacaggagtagggtattacttcttgaataagaagacctgaacatgtataaaatcccttgtctccaaacccatccactttcctagcttgatagccacccccttttattattgtcgaaatcttgcttcgacagttggcgcgccaggtaggggcagcgtcaagtttttgccgactaagtgcgatgggttccgtttctggcatcgacgacttcgccttccctcctgagcagacgttccggttcggcagcctcaacttcatcaccaacgacttcggcaagatctctctccttgactcggattccaaccagtcgggaagagaccaggtccctgtgccgttcggtattccgaactcggccgaggcctactccaagatcatctctcccgagtcggcttcaaaccactcggacgagatccaatctacttttccgccaccagatcaagacgacgggtcctatccctcaatcctgatgaaacttcctgatgatttggccgctgtcttcacagtcaagacatctcccactcgaagatctaggcgagctccggcttcggccccgatccgatctagatccagggaggttggcgttatactccaacctcttgggacagtctcgacgtatgagatttttactcggattcctatcaaacatgtctatttttggacctttgagtatttatcactcaacccttcttgtattttttgtccttgatatgttcaagttgagaagcagtcggctgggtatcttactaagtaccatgcgtgcttcgctataaaaccactcggttcttgactatatgtttagttttttaactaatcacatagtcgggggctacacctaattaggtgcatctactcgatgcaccatgttttattttcgcccttcgcagtctttgattttagcactcggcaagctggagcaagttgaattgaagcactcggattactgttttttgttttgagaaggctattactgtcaattgcgaaggtctcggggactactgtggagatgatggataccccatatctacatgacagttataatttagtcggatatatggtaccaaatatagacagaatatctctataaggactcgggttagattctaaacttgtatgtcaagaaaatacccgggatcctagtcggttacgattgtattttatctataatcccatattccgttaggatatggacggtactttgtaaagtggactccttcccctatataaggagggtccatgtgcctctcaggacgcgattcttttttccaatttatacaatcaataatacactcggcggaatcatccccggacaggagtagggtattacttcttgaataagaaggcctgaacctgtataaaatcccttgtctctaaacccatccactttcctagcttgatagccacccccttttattattgtcgaaatcttgcttcgacacaaatgtccctgtgttttttgtggtgtttctttttgctatagtctggtgtggaaaatatggtgaaggaaaagaaaatgctagatttctttaaattaaaaaggtaggttttcttttgctatccagattcaacatttctcatggctcattattttacaagatgatcatcttttggtgtaataatatttgagttttttgcaattaaccggtttacactaaatttctattaactatggaaagaatggtaaaacttcacttagagcacgtggttgtgaacttgtcaggttcaaatccaaatcttattatccatttcagaaatcaatcacttgacatgtgaagtcacatttgttcaagctaccttttggcttatttagtcatttcactgtcgaagggaagccacatttgttcctttcttttgtaacatagccattcagtggatataaaaagctatataccattctagcttcattcttccctgttattttcggtttgacatattttagtccatgggttgttgacagagaattaagaaataatttctttagtttttttttgtttgttgaaggtgaaacaaaaagtcggcagaccttgctgtgtggcaaacgaatgaggttgtggggtcaagagagatgagcaatccatattgcttgatcctaattcgggcatgatggtggaggcggtgagaagttaagtagcgtgaaaagcatagtttctcaaacctttggtttgagacttttacttttattttgtatattgattctgatggcggatattttgctggctacctagcgaaattcaattgccacacataaacaatgtgtggggtttaattccttttttatgtaatagttttaatttatgtttttcaatacgtgcattgcacgtgcactactactagtcttacaaaaaggtaaattgatacaacgatttggaattaggtaggtacgacttattgtagcaattagcaagtgggtgcatcttaatacaataacttaagaatgttcctccgtctcacaaaaaaaccacacctaggatactattgtgtcaaatccaatcctagattggtttttttagacgaagggagtactattttagtgcagcaatttagctaagtatgtgttattttggttaacgaatgctagatgagttttttcatgatatcatgttatattataatgttgaatttaatctataaaaaactaattgctcatccaatttataccgccatcttggatttttttcttcaccttctaaaatctcaaccaaaatacataattcttttgatattaaaatataattgagagttaataaattgaagtatgcttatacaaatttcacaagtatattgaaaaaaggagtacttaattaagtttagttttttgcatccatatactcacctattaaatttttgcactaaataacacccacttgtcaagttattacactatagcacgcacttctcaagttatttcactaaattacacccacctgccaagttatcataccatggatgcaatttactcttttacaaattgtcgaacaatattgcaccacgttattgcaaagtgttttaacatgtatcaacaccatgaaaaaattttcaataaaaatgtttcggatctttcattgattgaagaaaagtgtttcattgctcaaagaaaatatattgaattttcaacacagagaaaaggggaccaaccatttaaccggtaaaacataatcgaagcacacttggagcatttaatttatagcgattgaaacatcgagttttctctattgagggcctgtttggcacaactctagctctacccccacctctcctggagctggagcccagccaaacagtttcagttccacctaaagtgggagcggagctgggtggagtgctctcataaaatgaactagagaggtggagctggatttagacagctccacaactccactccagactcaactcctagagctaaatttaggagttagagctctaccaaacaagccctgagacatccacggacctcgcttatcaaagatatatatatatatatatatatatatatatatatatatatatatatatatatatatatatatatatatatatatatatatatatatattataccatcaaaattaacgttgaaacattttgatccaacacaaaaaatcgaaaaaattgcaaaaaaaaaaatgtaccactcaagatcctccttcctcctctccggtggccagccatcaccgggcttgccactagagcactcttccatgctgccaacggattgtggctgccattgtgtcacaccaccgtcgaggaagctgaggcctagctcgcaccaccaacatcgaggatgagagatcatcgttgtcatgtcgcactaccatcgaggaagacgtggccaaccacgtgccaccctcaaggaagttgaggtagagctctctccatgttgcccatgccatgctgatgacgagaggcgaagctattctatgccgtgtcgagcgttgggaacgagaggcggagctcgttactttacctccatcgcatcaacaacgagagagcacatctgttggggatgagatatggagagagaagatacggataggggagcaagaggaaacgatttttgtggtgagaaatgtctccaagagatgttgggcgttcgatatttggcttgctatggacactcgatatgaagcgtttctgcaatacaagtagtaagattagataaaactttttaaactttctatcgacttttgaggtcacgactacgatatttggatggtatggagatcttcgatatttggtgtctattctgatttgtgcatcttgtgtcttggcttgtcttggtttttgttggtttgtccatttcctcctagggtgcttgtatttatacccataggtgtccccttgtccaagtagactagggagaccaatatggatacgatccaaatagactagagttgccctcagcaatcggagttcggtacccttcctagcccctagctgtttttatggaaaagccattttccacaaagacagcttaaatcttataaccaagcaagctgaagctgacaaaatcctagcccctagccatgaagttgggaaaaccaattcccgattgcacggcttagttaatacgcattcagaatagagcaaaggaacgatatgatcgacttcgagacagggcgatataagaaaagaggatcaacggacaaatattgcatatacaaacacttacagaggttgtcggagaatccatctcttgaacccatctcgtggagaccttgaagcatcaaaatccccctagcgcgccactgtcgactttttaggttacgactatggtagttgcatggtatggacatcgttggtaccagggtatatgcaagattcaggtaaaagagatagagacaagggtttttatataggttcgggccccttatctgataggtaatagccctactcctgttggccgaagccggtgttgctcttattcatctgaatcacacaagtacaatatttgggataacctatctagctgtcgtcgacttggcggcatagataaccaacacgtagtcaacgacagggtagtcttccttctcgagtacgaactcaccgagatcagagatggcgcaaatccctcttgtcggcttccgcaggcaccatattgggtatgtctaggctcatctctgatgtcaatgtctagcggcgtgtgttggtttgttctggcttgtcttggcttagtccctcctcctcttaggggttttgtatttatacccatagatgtccacttgtccaagtagaactagggacaccaatatagatacaatttgagtagtccttatcatttccacatagaattctacttgtccttccttatccggaactccttttatatacgaggtatgattccatataagacttagtatatggtgggtgatgaaccctaagttccactcgagactcaaggctgttgttggcccgatctttcggtgagttgagataactacgatttgggagacacgttgacggcccaactacaaccgtacaagacattgcgttgcgccttagcaatcgatacacctctccatgggttgttgatcttgccggtacaaatcaaccttattcctgcaagcaaatcgaagaaacaagcaagaacaagataaaagcaatctgaatttccaatagttgttgaatacgaatgataagttggggtttcgaatacaagcagatggatggtctagccgacgcgcgcgctgcaaggaagtagcaatggctaaactttcatctaaacaaaacccgagaaacccttaaggggtacctagctatttaaggaggtgggaggacgaccaagagggtcctagggtcgtgctccaccagcttggggcgcaccccacatgggccccacctggtccggggtcccaaatgaagttacaagcccacaggcccattataggtgacgcagcaccttgttcctgtgattccggccacacgagatggaattcggagaagaagctagatccgttggaaagagggctccgagagctttccatcaaatactcacgggccgaaaacggaggtcgtatgcagattcggcggctgtttgaagtcaacagtgtagtaggtggccgaatcggattccagcactgggaggacttgatctcgatgtcttcttgttagtccatgatgtgagcaatggttgcatccgtggtagccatggtcacatcagtgggccccactgagcttagtcaattactattgggtatgtggtatacataaccatgatagcggccaaaatggctctcgcgcggaaacagcctccatgcggctccgccccacaagctatatgacaaccatcactgcttccaagttcacttgcgaaggcgatcaacgaggccgcactaccagggcagtctccatgtcactgcatgctccacacaatcagagctgcatcagctcaccgtgtccgctacgaccggcggacggctccacagctggcaacgtcggctgaagcaagccatcgaggccaactcgtcactccacgcggcagaagctgccttgaccttgctagctttgcggacggacaaccccgctactgttgatatttcttaacgacattactagaaatataattcctagcaatgatgtagaaatattcatggtatacttatggttacagatatgatccgcaagcgcacggatataccatttttttaatccaaagtgaagatatgataagagagtactatgctaataatttatatattacttgcgtacatcaaggtcgatgtaggggttaagtaattcaaaggttaggtgacacacagaagaaagaactatgatactctcactaaatataatccaagctaagtggaggaagaataagaaaataattcattcctatacttctaatatgcaaacatctttagtctacacttgttagtatacagtcatgcaaccaataccccctaacagtgccctcctggtgtttcgagagaccaccccgggttgccgagttccttacgacaatctgtaatggctgtccaaccggggctaaatacggaaaagtaccctccccaggaatttgtcttaggaatatatactatcatggaggaatacctgtactgagctgtcaccattagcgacccacctcgactgacccgtagcatatatgctcagatagggatacttaataatctagataccacgtctacattattaaatactactctatatcccccgagatgacatagagcaaccgagcaatcggacactaaacccacaccattgcacctctctgatagactagctacacaactatattgatacaagtataaaatgaagtcggtactcagataatataaatggaataaaataccgaagatgtataaagaaaaatattctattaattcaataagtcttacaaaagaagagaggaaagctactagagccatacccgaattctcctgaagacccgaggactaagaatactattctaattcctactccactagcactagtatactactaaacttgagagagggagagagctcttcttcttgagtgtgtggagagagtgaggatgtgaggtccttatatacggcagttatgacggttataagtatgcgaaatgtccattctgccccgcaactgccatcaggacatcatctagagcgtccaagccaaaacctggaatcaacggcagagatgggggtgccgaaccatgggcttggccattctggcccccttaactcctcataagtctggatctcaacagcgtccgattgattgatcgtttattttgctgtcgattctcgtccatttatatgtgcttcttctgcatacatgttagtagcatagtatatagtggaagtagatattttatttggaaattatgcatcgcaaccatagctagtcttcattaatggggtaatattgacggtcgaaattggtcgataacgaccgtcaacagctaccatgtcaagcgttgccccacacctcagtgcctgcctggctccacgggtgctgccagcactccgtcgctgctgtcacgtcccaaaacgaccctaaaatgcattccttaaattattcctaaaataagaaaaattcttgttaaagtcttcaacaataaaatgtgtaaacctaaaagtcaaatgaggcttggagaatttttgtttattttctcaaagcctaaaatgcgtaatcaaatttagtggaattttcagagcacaaataataattatcaagaaataaacaaagtttaatagtttttctaaaaagaaaaccctaaatcccttcccctctctctgggctgaattcggcccattcccctccccct

SEQ ID NO: 69573 - DNA, 10491 bp, Oryza sativa
  unsure (1)..(10491): unsure at all n locations
gcagccccccaaccctatttaaaccctccccgagctccccacccccgtttttgccactcaccgccccctctccccgtcggaaacgagcccgcgccgtcatctcctctctccgccgtcgccgtcgacctccggccgggcctagccgcccgccgggaccttctcccgcctcgacgtcgcctcctccagcttcgccgcaccgtcaccgacctcgtccacccctccgtcccgctcgacgcccgccggaaccccgccgccctcgtcgacccaagccgcgccgccacctttttccgctccggctgcctccttcgtcgccgctgatgccccggggtgagccgtggaccgccgcctccttttccccctccccttcctctcggccgacgctccaccgcgccgatggtcgccgccggcaaccatcggggtgcgagggccgcctcccgccggctgtgccgacgtggctgccttcgggcgcaccgcgtggccgccgtgtggggctcgcccgccagttgcccgtgcccttgggtgcggctgacgcgtgggcccacggcgtcggtggatggcgaacccgtgcgcccggtccaccgtggaccgtgtggctgccgcgtgggtcccactcccgtggacccggctcacgtgtgtgcgcctcggtgctgacacaataatgtttttcaattcaaaaagaaatgaagaaaatcgcaaatattcacattaagaacatataaccttcaaatggttgtatcttggtcgtttgaactcggaattgcaccattcaagtctctaatttttccttaagaggtcaagaacccatttttgtgatttgtttcttttggttaaatggattttagtagagtaaaagccttttctttatccgttggttgtgtagacgctgtagcttcggaagatccgctctacattgaggttgaagccgacatttgggaaagcgagtaaggcaagtcatatctcctttgaacatatttttgtcccatgctttaaaattattttgttttaaattaatgcattatcgctttatttaaattcccgcattatcactgttttatttagccatgcatatttacctttgttatgatcttattattattgttattgttattattaccttgttcaccctagagtaaacaaaaccccactagtgtttaccgtactatggtctcactagtaccatttttaggtagaagcttcgctatttaaattagacaaactttaggtggatttataactttagactttgggaattctcatatcatttggacattatggaatggttggcttatgtggaattggacacacacctccccctctattcaaaacccccaaaatggttttacgctggctcgaggtgcatggttttaatagtagcacctcggccatcataaggaccggtcttcgggcctctgttgcaaagcactaccgtacttccacatgtctagtgggtaaggcatactttgtggctcagtctggtcgtgggcaaaagtacacggatagagatggacaaagttggggtccgatggacatctctagggcaaatgaaggctacacgagctgcggcccggtagtcgagatgtcatggcacagggccggtgtcctgcagctaggggctcaaccttggcctaccagtcccgggattccggccgtagacagggttgggtcggtactcttgtttatggctgggatgggttgggaactatgttatgtcctccgtccgtatgccgtggtggtatgtggcacgtggttacacgtgaggaagacgtgtcttgtgggtaaagatgtacacctctgatcagagtataatctattcgaatagccgcgccctcggttatgggcaagcctagcaatgtacccaagttagtggtttaattcttaaaacttgctgaaccacatgtgcctgccgtcatgtgcatgtggtcgttaccttagtcttccgctgtttttcgtttatcttcatgtgtgctaggccttcgttgcccatgtaataaattaactatttacgcttccgcttgttaaactctgaattgtatcaacttttggtgtaccttgcctcctgggacaaggaatattacacgcacgtatggaatgcctgttgggttaattccggtcatgaaagctaccaacgctcccttgtgcacaacaatagtcaccgttgttccctccgttgctgatccctccaccgtggttggtcgcagctccctccaccgttggcaacgaaacccttgaatcaaccgctactccctccgcttgggacggattggggatgggattgagatatggttgattagtaatcaggtgtattttggtcactttgggttagtattttttttttattttcctgaatgaagtcctgacggtagagtggaaacagggcagaccaaaactttggttttgaaaagcagggtcaaatgaaaaaacataaaaaagtagggtcaaattgatagttaggtttcataatacggtcaaataactaattgtcgaaaacatttatgttgtgtcttagagattgatacacctctcctataaagaaaggaagagaaggactaggattggaggaaaaaagccattctttgtttcggcccttcgaggaagagcaaactgaagtattgccgcttcatcccatcgacgaggtcactggtttgactgatctggcatgggttacatgtcgttgttgtttcttgggttacatgtcaggtgtaaccgtcccggaaaccaccataactgccacaaccgtcgtagggacccacttgtcagtgccccagagaagtttggagtcctgctgggccggcccagattcggccgaaccgccaaacccttgtgacgccggctccggctggccttacacgtggatgctcttgatcgctccccaatgacggttgcagggcatattggacatttcgcataggctacaaccgtcatacctgcctatttaaggaggagctcatctacacttcaaaacacactctagcaagctcaacatttctctctatagtttagtgtagtattctagtgctaagtggagtagaatagaatagctctcggaatcctcggagtcttcgaaggaattcatgtatggctctagtagcttttctttattcttttgtaagactttcggaattaatggaatattattctttatatactctcggtactttagtttatctaagtatcggctttactttatatatgtatcgctatagttgtgtaactaggctaccagagaggtgtgtgggtttaatgttcgattattcggttgccctatgtcatctcgggggatatagagtactatttaataatgtagatgtggtgtctagattattaaatatcattatctgggcatattatgctgcgggacagtagaggtggatggctgatggtggcagctcagtacgggtattcctccacgttattatatattcctaagaaactctcctggggacggtactcctccgtatttagtcccggttggacggccatgacaggttgtcgtaagaaactcgacaacccgtggtggtctctcgaaacaccagaagggcattgttagggggtattggtcgcacaactgtgtactagcagatgtaaactaagattgagtgtatactataagtatttgaattgattgcttttctatttcttcccccacatagcataggattgtttaacgagagataagagtttttttgattcctgtcactctacccttgtgaatattttaacccctgcttagactctgatctacaagtgacatatatacattattagcatagttctctcttacaatcttcccttgggattaaataaatacgataccttggaatactcccgggtgaaatgctacaatggtatatccgtgcgcttgcgaatttcttctgtaaccatatatataccaggaccatttctggcgccattgctggaaattcatattttagtaatgtcattatgaaataccaacacacgcatgcgaagtgatctatgcaaaggcgatggatgaaaagtgtcatgaacaaaaaaaaacaagcttgttaagtaggtaaaagataagatgtgattggttgtattcataattcaagatagtgttgacgtaaaacacgaggcctgagagatctgcttaactccagtgcatgtccaaaactcgccttcgggtatgcaagcaacaagaaacaaagacaaagaaaccgcggttaaacctataaacgatagccgatcggctaagggccgatgacatatcatttatctttgacccgatatcatatatgtatcgatcggcagccttgaataaataagaaggaactaaatctactcgattggttgtagatattaacaatatatactttttatatcaatatatacttaaatcaagtgattgggatagatcggtcgccatgccgaaacagtataaatcacttagatcgaaatatatattaataatgggactatatatgttcatagcatagccgatcagatagatctagcatgtatcggctaatacttcgataccactctatactaagatattaaatcaagcagaatatatcaaacaaaggcctaatatacttaaatgcaataagatcttaaaataaagggcagatttaacatatcaatgaaacatatatagagtaaatatagttaaatcaggtaagatcggttgaaaccccgatactaccctaatcggcaaccaagaagcaggctagagattaagattctaatcacgacttataagatcaaactcaactgatgcagctataagtatgaaaagaaggacaatatctaaacaatcaagccattggaagtttcatagagtggtggatacctcatataatctaagtcaacatcgatatctaacctaatcggctgccctctaccgacagatgttagccgattgtagattagattgtagattagatagcgatattactagagattatgttagatatatgataactcgacaaattacataaacaagactagagtatcataaagatggaagcactaatcccgagaacgtaagccgccataacaagttttacctcttgttgaagatcgaaaccgatgcagctcaacccgaaagtaagaactcgtcgaaacaaaataaaagtaaaaagggtggcgatgcgctgagattgcattgaacgtctattcattgattacatggggttcggggtctatttatacccgagaattacaaactatatccatatcggacacgtctcttatctctaacaaactctaatatatcataagtctttatgacagacttttgcccaaacatatctctaaggaaattacacaaaatatcctaattaatagatacaattgccttctcaggactatccatgcgtggcaatcatcttgaagcatatcaattcaacccgatgacgtataccaagtcgtattgtcggaatcggctgtatcatctaacccagtctgactcggatttagccgatcccgattgtagccgatttggactccagccgattcttactctgtttccgcaacgatcttcatcttcgattccgcttcgatctaatcttctttttcgatactgatattaccaaatttggtcattaacagatagtcttggttacaacaggactaattatttttaggtctgcttatctaacatttgacataattttttttttaaaaaaaggcatatgtacctaagacaatcatatttaattacaataaaactaaggtgtaagtagtatgtaactacatgaaaactgctatagcttgatgggatagacaagcgcacctaatcacccacgtcatgcgatttactattcgcaagggaaaagtaggacggatgtattattattattattattattattattattattattattattattattattattattattattattggaatgtggcgttccaatggcttaattgcgaagactagtactcctagatgggacttttttttgacaaattggccatttacaaaaacttattttgaaactagtccctaccaaaaaacttcaaccaaaaaataggccgtcggctcagcaccaagagcgctggcactgaggttatacccagaagcgctaacaggcctggcgctgacatcgtgtcaccgtgacggccgagcgcctcccgctgccaacgtggcagggatgtcagcgccaatttccatggcgcattggtgctgagatacccaacctcagcgccaaacacattggtgctgactgttggaacttaaccattggctacctcaacgccaagtgatatttgggaaaacgttcaatctgaaaacgttctatttcaaataatgcgtttttgtcaaagtttcatggatgagctgtatagatattttgggcccgatcaggtattcctatcagatataatatctttttttttagattatgtcatttttctatatcagaaggtattccgattagaaaaatggaatcaaattgttttgatctaaatcagaaggtctggttctagtttccgaacagaagctactggatacggactggtaaagtgttgccttaacatttcctgtgagcagaaactattgtattccctccgtcactaaatatttgacacagttaactctttttaacatgtttgaccgttcatcttattaaaaaagtaattattaattcttttcctatcatttgattcattgttaaatatacttttatatatacatatagttttacatattttataatttttttaataagacgaacggtcaaacatgttttaaaaaatcaacggcgttaaatatttagggaatatttggggacagagggagtatatcatgttgcttgctactatcattctttcacaactttccctttttgttcctgttgaaaagagtaattttataacctgttgcaggtattctttgcacgtgtagttcttgctgatatgaacaaggaactcaaaggattaagattttaacatagatctatttagtttatttgtatatagttttgtaaccatttgggacttcctaatgtgcatggcttctgcagatgtgtgataagtggttctggaaggatagcaatgcatgtattggaaaagcttctgatcaactaacgtgccccattacttctgttacatggtactgacaattgcctacataatacaccaacatctctataaggtcctcaatgcatggatgcatgcctgatgaatcaacatatagaagtcttatatgagatttgcttaaaaacatcctttttgtgcttgcttaaaagtcaatggaacaattctaatgcatattgaatttacaaccaccggtcacaacgttcctaatatctatgcctatcaacatcaaaattaatcaatatgaatccccaaaatatttacaatacacatccctctcaagtctcaacttcactctaagcaaaatagtgcataacttacaaaaaaaactatatgaatcctctatacttacaactataacatcgcatacttacccacattccctaatccacaccacaacccgagccacatttaacaacccatgatttcaacaaaaaaaactctacaaaaatgaggaaaacattgagaaaattagggtttttagagaggatttaccttgcaaattaatatccaacgcaatgcccaccaaatctaaagtcttcaaacctccccccggctgctcgtcgctcagcgctttgcgctggcgtggacgtggccggggtgcgacacgtcgcgcggcgctggaggacggagggatttcgtgagcgctcctgcatccgcgtcgtctctagaattttgcataaaaaccctcgcatttatagatattttgttatatgtcctcgctgcaatttttttggtttacaaatattgcgtttaggcccttcgtgtcatatgaaatccaatacgaaggagataaaagggaaaaaaggaccgcgccctgaatcgtgtaaactgatgggtctttgcgcaaaaggctctccccgagaacctccccagcccccaggcatgtcaaaacaaaaaaaaaaagaaaaaaaaccccagccgccgcacccctctcatctctctcgttctctcctacgcgccgcctggatgtggcagggcgtggccgccgcccggtgtcctcccagcgccccttcctcccccgctacgccgtgcggccccctctccacgtcacgtcgtcgctgccaccgccgcggcgcactcttgtcggggtagttaaagatgagggctatctgctcgcaccacagaattttggacggcgtggacgcacgcacgtgtatccacgtccccgcgcatgtatccacgtcccccgcgcgcgctggaaggctggtgattttcgtacgctctggttgctcgcccgcagcgtcgtccgatcaaacatctagcgaccaaagagtggagaaggctacggatcggacatccgataaaacttaaaagattggatgtcctacctactgcaattctgacgattcatgcaaaccatgcattatgaaccacctcttccctattgtatacatgtacactctttatcaatttttgaaatgatttttctcctaacctatctatctgatctatgatctaattatatcgttatattcgttgtaattaaatttttataacaagatctcacatgagtatattacgttgagaaaaacatatgaaacatttttatactataaatgaaacaattgagttataagtactgaaacatcaaaagaacactattgcaatatttgcaaataaactagtgaaacatttgaaaaaacttattgaaacacctagataataggatttgcaacattcaataatccgtagcaacacaaaactttaaatgtgcaacaaagtcgaattaaaaattaagacatttatttctcacgcgtgaaacattcgattttaacggttgaaacatgtaaaaagataatgtacaacattgtacatgcactagtgaaacatcaataaatacttgttggaacattacattatcaatgcccaacatttaaaaagtaaaaaaaaagtcgtcgacatattgtcgtgtgatatcttgttacaaatatttaattgtaacgaatccaacaatataattagtttgaaattcggataaatagtttaatagaaaaaatcatttaaattttgaaacatactcgcatgtactctctcttagctaactggctatacacatgcgctaattgctcccttagattttttacgtacgattttttctttccggccgaattgaacggcgatgagaagaattttccccaaagagagctggtaattttgtaaaaaagttctcgcttatcttgataatcattattaagtccctcattgtaagttcactgtcctatgtattcttacgtaaagaccctctataggaccgcgctctgaaaaagtgcaagtaaggatgttttctgagaaatagaacaccctatccccccattcccccgaaaccctaccactaccctaccactactgttcccccatccctcctcttcctttgccctgccctgccctagcgccgccgccgcttttccttccctccccggcttctcttcgccggcgacgacgatgcggtgcggtgtctccggctcagattctaaagattctcgagctctccatgtcaagtaaagggaatggacggtgcggtctgttccccgaaaccctagccaccactattcccccacccttttctcgctctctcccctgacctttgcgacggggcaacctcgacctcgacttgccctcctcttttcaacgccgccgccgccagccttcctcgcatgccctcctctgacctaccccatatcctggagctctccctaccaatgctcccttctctctctctctctctctctctctctctctctctttctcccctcagttgagctagctccggggaatgtggtgatggagatcaatggtgagggggatcaatccgctagcccggtgcttgatttggtggataggcgcactcaatcttgaatccggtggtgttgtgctcagctcgggcatgagggggttgatccagaactgtggattgaactcaagatggtgatggtgaggcaagagctccacggtggggtggcatctcttgctcaagcttaaggatccgccgttgtgcgcgccatcatcactattcatcggttctacatctaggcggtaggtcagattgaaaccacatgccgtcgcatagaaaaacttcatttgcagttgggatgccgtcctcacttccggtgagtcaaagcatcaatctctttctctgtagacttgcctcatgtatagctggcatgcatcttctttttcctgcttccctgggttccctgctcacactgtgattctaacatcccaatctgaacaggcaaactgtcaaacttcgttttttttttcatgtatcattcttctattcacaatgataaacattgatagcctatcaaatttctttatcataagtgctagaatatttctgatttgtactgcatctcaaattgtacatgcgtgtgagctatnnnnnnnnnnnnnnnnnnnnnnnnnnnnnnnnnn

SEQ ID NO: 69574 - DNA, 3523 bp, Oryza sativa
atgcctatcaaaaatagatttttcagatttgaaaatatgactatcaaaagtagatggagggagtattttggaatggagggagtattagtaaatagaatatgatcttgttggattgagtaatatgcaatcataactccccaatgtacttttgaagaacagtgagagattgattaaaaaaaagaacattgagagaagatttgcctcattttccacgcgcatgcttcccgaactactaaacggttttataaaacaaattatataaaaaagttgcgttaaaaaattatacaaatcatcttttctagttcaaaataattaatactcaattaaccatatgctaaagattcaccttacgtattttcactccacgtagtcagcacataccacatttgaactcttctggtcctaattctacctcagttttttaaatagatgatgactttgattgttaacacatatttaacatttattttattaaaaaatttacataattattatttattctgctgtaagttgttttgtcactaaaaatttttttggggcatattttaagtatgatttatatcttatgcatttacataaaattttttaaataagataaatagtcgaatgtgtgtaaaaaaaataacggcgtcgtatataaaaaaaatagagaagcacatattttgtgcattgacttaaacattcttaaatgcaccaacccatggacaaacacgtactccctaccaaacacatgtatgttcctgcttccaaaattaatggcatcatttgattttattaaaaaaaactttatataccaccttcatcccaaattagtgatccttttgactttttgcttgctacgtttgaccatttgtcttatttaataaattagtgcaaatataaaaaaaaggataagttatacttaaagtacttttgatataaagcaagttacaaacaaaataaataataatttcataattttttgaataagacgaatggtcaaacgttacagacaacaactcaaatcgacaagtattttgggacggatatagtataaaagtttattgaaaagatgaataaatccattttcaaatttacaatggtttactttttcaatcaaatcacacaagatagtgtgaggtttcatattgatataggataaaaaagttacaagatcatagctatgggagatcatgactatcatcaggaaaaataaaacaacaagccatatcacacgcctacaacaaagcgaaccctctaaggaaacaaacaaaagcgtcgtgttttatctacactcaacgccatccacgtccttttgttgtagagggagagggcgatagagaaatggatccattctccctcacatgaacccaccaacatggtcattttgtggcggtcagaagcgtcgccgcaagaggacaaatcgtctgcataagagattggtagaaaatggaaatggaaaagcatcgccgctgtcaacctggaagcagaccaggatgtcgcccaaaaacatccttccctcgcatgctgtcgtgccccagtcatatgtgacggttgccaccatccgaacaccttcgacgtgtggccatcgtaccaatgctccaataccggtcgaccattgagatgatcaatggcccacacgcggaactctggtaagtcgtcgacgtgtcggccatcatctccccacatcatacttaattaatgaagtgttttttgtgccaatcataaccatctttcatttatttttttcacatactttcttttctcaatcaataacgatcatctttaatttaatttttactctccttttatttttttaataacttcagaagtgatttgcgacagaggtggtaacatttaaacaaacaagtacacccaacataaaagctttcgttgtactttgtagaataaggctgtgtttagttagttggccaaatttttttttgacgtatacggacacatatttaaagtattaaacatagagtaataacaaaacaaattacagattctgcctgtaaactgcgagatgaatttattaagtctaattaatccgtcattagcaattttttactgtagcaccacattgtctatatcatgacgcaattaggctcaaaagatttgtctcgcaatttacatgcaaactgggcaattagttttttttcatccacatttaatgctccatgcatgtctccaaacatttgatgtgacgtttttggctaaaattttttggaatttaaacacagcctaagtgaataacttcattacttccctgctggatgtaatgagtgcacctggttgttcggactgcgatgctactaaggctaagtttgagatgataggaaaagaggagattgagaagatacgcaaaacgcggtgagctattatcttatgattagttgagtattaactattttaaatttcaaaaatagattaatatgtttttaaagcaacttttctatataattttttttgcaaaataaatatcatttagtagtttgggaagcgtgcgcgcagaaaacgaggtgttttctactcaatctcacagcaatctctcctatcaaacgaagccttatactagcaacttctcctttaccatcacattacctttcctaactgaaaattttgattccttctattgtaaaaaagagtggtttctgatccaaaatttacataaatactccctttgtgccaaaaaaaaaaaggccaatcctacctacattcgtagctaggaattcgttttttttttacagaatagtagatattactacttcaacttttaagagatatttatattagaactttcagaaataggggataaatttattaggactagataaaattaagagtaattgtattagaatttgataaagtataggatattgggataatttatttttcttttatatttgtcagtgacatgggaccgggagtatcatgacttagagacttgaggcagacacgatcgcccacgtggcctaaccccctcgggggggtcgggcccgagggtgatacggccgcccttctctttgtctccccgaggggtcggaccgctaccgcctcggccctgagggccgaggcgccccgaccccttgtgggttttgcgccgcgtatatggggtaggtgagcatagcggggctcacctaaccacatttattgcggtttggacgagcgcgtcacgccgcatggaacgcagtgcaacgcgctcgtttatccggtctgtgaccggtcacagaccggtcagatcgtgggttaggtggcgataggcggtctgacgcacgcctcgccccatcccgtcaggacgagagcctccaagcactcgtccctagccggaaccggcgtgttagctcctggagatggcacgttggttccggtcagatatatgccaggctttatcctaaccattacaggcaagatattgtatgaagaagggtgaacatgcagattgttaaactgacacgtggtggacaagaatgaccgatttgtgatcggtctgacaatggtcatgtcgtcagcagacagccatgttcccacgtcgcgcctgctt

SEQ ID NO: 69575 - DNA, 16128 bp, Oryza sativa
gaccttgcccacttagaaaaagggggaaaaaagaggagaacgatcctagaacgagaggggggctggctcggactttgtagcttcttcatacacagatccaccaaaacacaggagtagggtattacgcttctcagcggcccgaacctgtatacatcgcccgtgtcttgtgtgtttccattctcgcgaactttccacagaccaagagcttagaacctcacacagggcccccggccgaactggcaaaggggggcctgcgcggtctcccggtgaggagccccacgctccgtcatctggcgcgccaagtagggggttctgcgtgtgttcttctaagctctcgcactctttcgtgtgcgccaagcttttcctgttcagcccaatggccgaacaagcaaaggcgcacaacctctctccgagcgttagcggcgacgatggggagccaaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcactcctacgtcacccgcccattgtccttgacccggagtctccagcccaacgttggctggacgacgtggccaacttggtcatgacggcacggcagcgcctaggtgctggtgggcggtcctccgccaccaagacctctggcgctgctaccaccggctccgtatcgtcaaggcggagggcgcggcgagcggcggctgttgctcgccattcggccgccactccttcgtcagcgcctccgacccaggaagatctgcgtggggggccggatgcccacatcgatatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgtgcccaggtgaagaagcggacttacatgcagtacagcgaatggatgatgagtcacttcgctcgtacattcagcggttctgtcaagtccataacaccataccatgcatccctgcacacgcggtgatctacgcgttcaggggggggtgtgcggcacaaccgcatgctcgaaaagatcgcctccaaagagccccagactaccgcggagctttttcagcttgcggactgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcgagggcgcttcgcgggccacccgaaaagggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctaagcggacgaggaagtgggaggaggagaggaggcaggagcgccgagagggcaagtccccggcggttccttccggcaatcggcgaagtgaggccaaacagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggcttggcacctccgcccccgccgccccgaggcagcggatagtcacatgtgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggtcgggcgcaaggccggtctggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacacttaccccctgcctcgcatagatcagattgtcgactccacagcggggtgcgaccttttgtgttttctagatgcatactcgggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataagactgaaccccgataaatgcgtgttcggtgtacctgcgggcaagctcctcgggtttttagtctctgcccgaggcatcgaggccaaccccgagaagatacgagctatagagcagatgcgccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacagtcctcattccgcgcacccccaccctgtgctggcttggctcgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggacgtggcccctagcgaagaggatcggccccaccgaaaggtgcagcggcccgtctactttgttagtgaggccctccgggacgccaagacccgataccctcaggcccagaagatgctttacgctattctgatggcttcgagcaaactgcgtcattatttccaggcgcatcgggtcacggtggttacgtcttaccccctcggccaaatcttgcataatcgagagggtactggacgggtggtgaaatgggcaatcgaactttctgagtttgatttgcactttgaactacgccacgctatcaagagccaggccctcgccgattttgtggcagagtggaccccagcccccgagcccgtctcagtccccgaggccagctcgggcccctcgcagctgcctcacaccgcccactgggtgatgcagttcgacggttccctgtctcttcagggcgccggtgcgggggtcacgttgacctcgccgagcggagacgtcctcagatatttggttcgccttgactttcgggccaccaataatatggcagagtacgaaggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgagctctcacggctcgcttcctcgcgagcccagaccccaccgggcgcctttgaagaaaggcttgcccagccttcggcgcgacccgacccctcaggggagacggacgcgcctgacaggcccccgaggcctgtcggagtccaggcctcgggacccgaggggagcgctcccagctcccttagattgattgcttggatcgttgagatccaagcatacctcacagataagactctacccgagtaccgcgaagggagtgaacgcgtccagcgcatctccaaacgctacgtgctggtagaagggaccctctatcggcgcgcggctaacggaatcctcctgaagtgcattcctcgggaacaaggcgtcgagtttcttgccgatatccatgaaggcgaatgcggatcccactccgcctttcgacaaggtttctattggccgacagctctcaatgatgcggtcgacctggtccggcgatgcagggcgtgtcaattccacgccaagcaaatccatcagccggcccaggccctgcagatcataccactttcatggccatttgctgtctgggggctcgatatcctgggaccgtttaggcaggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattacttcgaagacatgggcatcaagctctgcttcgcctcacctgcccaccccagaagcaacggccaagtggagcgcgccaatgcggaaatcctcagaggccttaaaaccaagaccttcaacatcctaaagaagcacggcgattcgtggatcgaggagttgccaacggtgctctggtcgaaccgaaccacgccaagccgagcaaccggggaaacgcctttcttcctcgtctacggcgcggaagcggttctcccatccgagctcaccctaaggtcccctcgggccaccatgtactgcgaggctgatcaagatcagcttcgcagagatgacctcgactacttggaagagcgaaggcggcgcgcggccctccgagccacgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcatcgcttctacccctaaagggggatcgggtgtcaggtttcgggctcaggccaaccccgcacccccctcgggcgtgcagggttggccgggggctaccacatatgcatattcttatatctcttgtatctgtatttcaataaaaacattttcaatttcctaaaggctgtatctgtgctgttgtttccttttgaaggatcttgacttgaaataagtcactcgtgttcaatcctgccctcgggggctcgggtcggctaaaatcgccaaacggggcccagaaccgagccgtgccccggggcgtagtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtgtcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccacaccgccgtcatcgccctcctcgtcggagttgagggcgaacgcgagccgaggggccgaaccctcgaagctgtggacgatatggtcggcggcatcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcccctcgagctcctcggggagccgctggagagtcccggccatctccgagaagcgctgggcgaggcccccctggttggcggcgtacttcacagtccgcccgccccagagacccgcctgccgcccggcgcggactagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgccgctgcgcgccctcgcgtccagctccttctcccgcgcctcgagctcagcggcccgctggttcagcgcggccctctcggcgcgggcaccttccagattacggcgcgcctgctcctcccgcactgcctcacggagggacaggctgtccgccagacgttgcgccgcggcctcggcctcctcgagagctcgctcccgctcggtgagcgcgtcctcgcggaggcggagcgcggactcctcttcggcgcaggcggcctcgtgcgccgccagcgttgcctcccggatggcaacggcggcctcgcggtccaccaggtccctctccacgacgccggcgcgctcttccagcgccatggcacgagcctcgagggcctcttcgcgccgccgagacgccgcctcggtctccgccgcccgccgttctcgggcagtggcagcatcaaggaccccccgggcggcgtcgagctttttccctagctccgcctcccagctcccgtattgaaggcggagggtgtcctgcgcctcgttcatcacagtggtggcgatgagggcagccccccgctcctcctccacctccttggcgatctcccccagcaccttccgacgggcttcgagctctgagacgtgccggcggtgtgccttgcggcccacctccaccatggcctccaccgagcgacgcccctctttgacacgtgcccatgcggcgtcgagctccacccgctctgcttgcaaggcctccatctgggcacttaacccgtccaacaccgtggtgttagcgacggccaaggcctgcagaagaggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagtgagtgggcccaagcgatgcgcccgcggcctcgtcgcgagctgcttcggaagtcgtcgtcgcctcggcctggcgaagtctggcctcctcccgagcggcttcttcagcttggcgagctcggacggccacctgagcagcttcctcggcttctcgaaggcaatccgcggcctcttgccggtcagtttcacgggtcgcctcggaggatgtcgtcgcctcggcctggcgaagtctggcctcctcccgagcggcttcttcagcttggcgagctcggacggccacctgagcagcttcctcggcttctcgaaggcgatccgcggcctcttgccggtcagtttcacgggtcgcctcggaggatgtcgtcgcctcggcctggcgaagtctggcctcctcccgagcggcttcttcagcttggcgagctcggacggccacctgggcggcctcctcggcttaccgtaggcgatccgcggcttctcgccggtcagattcccgcctccgagcctttgtggtcgccgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggggccgtttcttcttccgctcccctcgggctgcgacgtcggcgtggccccctccgggcgcctgctgctggcacgcgccgccccgccccctcggggaggagatgggggaggggttccttcctgcttcctcttcccccgggcgtcggcagggcggccgctccccgggcccccgtcgcggggcccagaagcacgaccccctcccggggtagatcgttcccccctgcggctcccgcccgcgccatcgtggcctcgaggagcccgctcctccgacgccctgaccgcctgcatgatggtcaggatggaggcacggtctggatcgctgcagagggggaggactccttgagaaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtatagaaccagtcgctcttccagtcatcccacttcttgcggaggacgcagggaatgtagtggttcagcaccggcccccgcggctggaagtagcaaccaccaaccaccgacggcggcgacaccggctgtacagtgaagaaccaccgaaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagctcggcctgtctctcgctcacgatgcgggaaggcggcagcacgctaccatcaagcggagcggagccccgtgccatgacgccggaagaagagatgtttgagagcgagcgcgtgtggcgaaggtagggcacaggaaacaaggagttagggcgcaagcggcgaagacaaggggaataatagtgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtctagatggaacatctcgtgcgcgcgttaattacgctcgccgaccgaagcgccatcatcatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccaggagtatcatgacttagagacttgaggcagacacgatcgcccacgtggcctaaccccctcgggggggtcgggcccgagggtgatacggccgcccttctctttgtctccccgaggggtcggaccgctaccgcctcggccccgagggccgaggcgccccgaccccttgtgggttttgcgccgcgtatatggggtaggtgagcatagcggggctcacctaaccacatttattacggtttggacgagcgcgtcacgccgcatgtaacgcagtgcagcgcgctcgtttattcggtctgtgaccggtcacagaccggtcagatcgtgggttaggtggcgacaggcggtctgacgcacgccttgccccatcccgtcaggacgagagcctccaagcactcgtccctagccggaaccggcgtgttagctcctggagatggcacgttggttccggtcagatatatgccaggcttcatcctaaccattacaggcaagatattgtatgaagaagggtgaacatgcagattgttaaactgacacgtggtggacaagaatgaccgatttgtgatcggtctgacaatggtcatgtcagcagacagccatgttcccacgtcgcgtctgcttccggcggaagtggaggtaggtatgggccgtcccatcagaaggtcattcggacggcagccatacaaatctccgtccattaatgaagagaagtcaagtaagaaagagagggagagatggtgcatgtggtatccccttgagatataaaaggaggaccttgcccacttagaaaaagggggaaaaaagaggagaacgatcctagaacgagaggggggctggctcggactttgtagcttcttcatacacagatccaccaaaacacaggagtagggtattacgcttctcagcggcccgaacctgtatacatcgcccgtgtcttgtgtgtttccattctcgcgaactttccacagaccaagagcttagaacctcacacagggcccccggccgaactggcaaaggggggcctgcgcggtctcccggtgaggagccccacgctccgtcaatattagtattatgaaatggataacaaataaagttattctataacagggaagtaacttttagcaacaaagacaatgttcttttgaatgaaaaaagggggcaattttcgtcattctttttttaatattcgagttttacattatggctatcagtgatgaatgcagtcaaataatgcgtcctggtaaatgaaaaaaaaatggcagaaacggtcggctttactcctagcattcacaagatttactcaacataatgaaccaatcctttcaaaggtcaaagtgacattcgaagcgattcgttatgagtaacggcaacatgcaagggaatgctcttactaagtatatgttcatgaaagagatatcacaaagataaaaccacccaaaagtttcaccattcccccgcaaaaaaaaaaaagaaaaagtttcaccattccagtatgattcagtgaattgtatcacattgttaatcacatttttgagtaacaatggaaattgacgacaaattcgcaaactgcattcttaatttgttatcttttcatcgctacaggcctacagcaaaaaaacaccttcaattcaagtagcctgccatttcgtcgaacaccttgcacctcattccttctcgccaagatcgccgcggcgcaccggtggccaaaccatcatctcgacggggaagatgtcgccgagcggcctcgactcatcggtgttgcgccacatcctctcaaacctccacgtcgcgaggtcgagggatacgacccagtcggccatgacgaagaacagcgcgccggtgccctcgcagaatccaccgaagctcacgagcttgcagccgcgcagctggtccgagattttcgccgagagcttgattcgggagaggtcaccgacggtggccgggttcatcagcgcgcgcaggtccaccgccggctgctccacccatttccccggcgactcgagaacccacttcgcaagaacgagctgctcccgcagcgcgaagaagcagagacggccgtcgtgtgtcttgccgatccagtggttcccggcgtacaggagcatcccggtgttcggcaatggcaccgccgagagcgtcatcttggtcgcgtcgactgccattacgtatttgtcttcttcgctctggagcttgtagaccacgtcgccgatgacgaccgtcgggccttggtgtgggttcatggacttcttgagcgctccggtggccgcctcccatgcggaggcggcggaagagtacactagaatgtcgaagtgggcagcagcgccgaagaggacgacggcgacgcggaacgccgcgccggcgccaggtaggagcgcgcagcaggcgaccttgtgtccggcgacgaagcgggaggggagggacacggacgtcttcctcagcgggtcgcagacgaggagcttgagctctctcgccgacccggcgccgagctcgcggagcaggaggcgccggccacggcagtcgacgaggagggcgccgcacgcgggcgacaccgagagcgccccgtggtcgaggccgaggccgacgccggctgcagggacgaaagggggaagcgcggacggcgcgtagttgcggaagaacccgaagtacggaggcggcgcggggagcccgccggcgccggagacgagcagccgccaacggcggcacaccgccgcggcgcggacgatgtccgccagcggcgacagcctcttgaacacctcgagcagcatgtcgtcgggcactgccgacgcccccatcccctccacctccacccgcgccgcggaaccggacccacctggcggcgactgagaccgggcccgcgccgatgccttcccgccgcgaccgcgcatctcctcctccccctccatccgcggccgcgtgcgccgcgccgaatcgaactcccccggcggcgactgcgaccgggcgcgcacgcgcgcgcggcggacgaccacggccgacggcatagccggaccaccgacaacaactacctccacaacgcgtcggagattggcaatggcgcggggagagacaaaggagaactcggggaggcgcgttcttaagggaggcgagaaggcgcggcagcgaaaattttgggggggcgggggggggggggtgcgtttgagatttcggccgcggcgaggcggcgcgagggagaaacgggggcggcctactatttttgttggtgatttggtttgccttttcggcttcccctcgcgcgcgtactatggagggtttctttccgtgtatttgccccaacttttcgcgacctgccgcgcgaggggtggcttggctcgcgtagcgtcggttcgttttgggcgatttttgggcggggcgggtggtggacgcgagtttggggggcaaaacgaggcgaaatcagcgggaaacggggtttatttttcgcgttttaggcgttgcgccgcggggaggtttgaaatggtttcgaatcgagtttgggggcaaaacgaggcgaaatcagcgggaaacggggtttaggccctgtttagttggcaaaaaaaaaaatattgatcttgcgtgtcacattgaatatacgaacacatgtttaaaatattaaacgtagtctaataacaaaataaattacatattccgtctgtaaactgtgagacgaatttatcaagtctaattaatctattagcaaatgtttactgtagcactgtattgttaaatcgtggcgtaattaggcttaaaagatttgtcttgtaatttacacaaaatctatgtaattgctttttttctatatttaatattacatatttaatatttaatatgatagcgtgaaaagtttttacgtgggaactgtcttattttcgcgttttcggcgttgcgctggcgggggaggtttgaaatggtttcgaattctcgtggggtttcgcttctactgcagacatggcagatggggcccccgttgttggtggtgaccatccaggcgtagagggtgtgtggcaccgcggggaggtgcatcgtgcacctggttggttcaggagacgtgtgtttctacttgggaaatccgatagatcgttttgatagtgagatgggctcgaggcctacgcgcgctacaccctcagcacgggttttcgaggacggcaatcctcctagaggatacggcgtcgtgtctagaagcatctagtcggacccaaaccattactataccaactgtatcggtcgaaaaaaaaattacgtcatcgttcttatcaggttacgctacttttttttatttctcgtgaacacactttttaacaggttaaatgttatgttttaacacgcttttcaactggttaaatgttatgttttgagcaaaaattttaaattattatatatgaatttggacaggtattcagctctatccgtcatgtccagaagcatctagtaggactgaaaccatcatgtcaattgtcttactctctgtctaaaaaccctttattttcctatcgttgttcttatcagcttacgctactttttattttatttttcgtgagcgagcacgcttcttaaatggttcaacggtttgtgcaaatactttctattatttttttgtaaaagaaaaatagttcacttttagacatgaatgtatacaactctttcggtcatgtctagaaacatctagcaccatcaaaatcatcatgttaattgtcttacttcatacgacagaagtactttatttttttgtcatctttcttatcagtttaagctatttttttatttttgtaagcaggtttctcaaaccgttaaatagtctttcttataaatactttctattgtcttcgttaaaaaataattcacttatatatataaatctgaatagctatacggctctatgagacgtctccagaagcatctagtctcacagaaaacatcatgtcaattgtcttactccctaccgccaaaaaacattattttttatcatcattcttatcaacttatgctactttgttttattttacgtgagtacgcttattaaactgttaaatggcatgtttcatgcaaatactttatatcatcttcgtataaaaataattta

SEQ ID NO: 69576 - DNA, 8464 bp, Oryza sativa
caaagcaggcttgttctatttttagaagacgtaatagccagattcaaacaaaaacacaagaactcagtgcaaaaaaaggaatgaccatctgactagtgtattagccagattataccatacacaaggaagtccatgggtcaatactacatgaaatgtttaacagagccttctaatccaaaatactaaaccttcagctccactatattacaacatgtgtctgaggctcttagcaatttagattgatttgagaaacttcagagtaccataaaccacagatcacttaatactgagtatggcagtaaaatatatctgtaccatgaaatgagtatattaacagatgaacagaagtatgcagctagagacttaaacaaatacctattgagaccaaggactgtatagtgatgtgacatagaatacaccctaggtcctgcaggagtatatgtccgcctatttttatgttccgagtgtgatgtatctgtctgccagtaccagtcgtcccgtgggacataattatatccacctggagggccattctccctccaagcttcataacttctcctaaacttgttcctctctctgttgaaaacactttgcatgtgtcttattctttgctgcaaaaaagcaaataaaaagtgaacatactgaagggaaatgggaaaaggacctgagaagatgttgaattgagacatttaagggatgaaataggaatcatttgttcctcgtgaatgtgtataactttaattaaaacatagctcacgataatttctaaaccttaacagcagcagttacaatgtataggcagcattcatataatgtccgacttccaaattcaaagtccaaagataaatgaatgtcttggaatataaagaagttaaaaggattatgcattatttaaaacttacaactctctcttgttcctcctcatattcctgttgcatacgttggtaatatcttctcctagcatcctcactgaaacttccacggttagagctgttacttgcattcctccaagatgttgtctgcatcttattgaacttttgaaagggagacataaaaggaacatataagtaaatgatggaaagaatcaaaatacagacaagtataagcatacagcggagacataggatgataaatcagtcatctgttattggctagcttcctgactacacagcatttttgttgggataacaatataaccaaagggattccgacatatagcagggagactgagaaataatcaaataataattgaatgcaatagcaagaaaagagtttgttcctacgcaaatccattgttggagtagaactgacgagggagagaggattgacaggaatcttaccctactggtctatcataataatgctcgtctatggggtagacacattaaatttgttattgccgaactgtactacatttgagcaaacaatctattactcccaaacatccaaaaatgtaagtcatattcaatactattatgaaagcatttggcaagacaaattcaatactatttattaaagctaacctatatatttttccatgtattaatggtcgaactctcattttgggactgagggagtaactaccgactattagatgtaaaaaaaaccctatatggtgttttaacctaaaaagaatgttccaccccacaacacagatcatgtctctatactgtacaaggctcaaaccataaagttttgggggcttcgcttcaattcattctgcttgaatagaacaatcctgattagataaggagctggaacaggacatttagtttgggatgtctacatttctctactacttaaaaagtggagatgcccatctcctcccctccgcacccccaccgagaggagcgtgccccatacatacccccccccccaccccctccacgcgcgtaacgcagccacaatccaaacccattgccaatcatatgggccaatgaatcaatgtccgcatggacatattattagttcaaagaaaagcaacagtttgcatttgaccaatcaacaaacagatagatgctaacttggatacctgactgtagacccaatcaacacttctgcgaacttgagcaacctgaaaattacatggtaagaagaaacagaaaggtcaagcacaggtgatctttgcaacttgtaagtcgtaacaatagcttacaacaagggtttgtttccagcaaaaacaataaccgtatatcacagttgaacggagatgcgaaaggatttccaataatagcaacaatccttagcaacccacctcgcaaacatgaggatgggagtaagtacctgcctagcacaaggtttacccatctgcagtgctcgtgcaatcttaagatagcatttaggaccttggggctttggtcagcaaagagacatatgaagccaagagcattactactaataacaggtttaaagagccacatgcttcgttgccacaaggagctgcataagaaccactaaatccttgcagaggctaggaatgttctcagtgcagttgtatcaccttgatataattgaccgggttcaataaaaacttgcattatctttaaaaagaagcactgaaggtgccactaccttgggcatgaaacgatgcaaacagcctaattggagcatttgacgccgaattgcagatacaggagcaaatttcatcaaagcaacaactaaatggaaacagtcatgtcatcacggaaggcgtgaaactaaacaagaaagctagtaagctgggcacttgaaacaggactgtattcgtattgaatcaatcaaccaggtcatcgactatcaatcaacacaaaagtaacagactaacagagaagaggggatgctctgctcaccgcgaaggtggcggtggtggcgccgatgaggccgaagatgaggatcccccacgccttggacggccgccgctcctgctccgtccgccctccgccgccaccgcggccggcgcggtcgtcctcccgcgaggccatctccctctcccaccacggtgctcgcggccccttatctcacgcgattcgagctcgacggctaggcgcgtgggaggccaagctcatgcttcccctcggccgaattccccccgcccctacgtctccgcttcgattcccctcgcgtggcgtccgctgcggttggttggttggtcggtcggagcggcgccgcgcggggtgaggaggatgattcggagttggattgctgggcggcgcggcgcggcgaggaggggaggggaggtggaggtggagccgcgcgtggaggcaggaggcggccggggacgggagggaaccgcgggtcgtcgtgcgtcggggaggcgccaaccgagtggccgaccgtggccgtggccgtggcgtggcacggggtgaaaaaatcgtggcgtttcttcggtaaggttcgatcggcggcacggtgacgacgtcgggatatctattctgtagactgtagcatagagatcggacggatatgtgtcgtgatagcgaagccgtaagcgaaactagtttctattcaaaatgtgctcgaaggtcgcgtgtatgaattctacctcatcacttatacaatatggaaacgcaagtactattcgtagataagctctagatgtaactaaatcttactttgtctgtttcaaaatataagtatttttagaatagtgtcaagtcaaactttctaaattttaactacttcatccatttcacaatataaaactttttagcattaacatctaaataaatttgggcaatgctagaaagtcttatattgtgaaacggacggagggagtactaatagcaaaaaatttaaaaagattaatcatgtatcattaaacgaaccatcataatatataactctttttatttaaaacatcttacttttgtagatttgtagatactgttagtcaaagtagcataaaaaaaccatatcgataaacaaatgtttatattttggagcggagggagtagtagagggacagcaataaaaacttttttgtaatcattgtattttgagtaagatcttccagatcttctacttaagaaagcccacctggttttagatgattatattaatttttagatatcataagtaaatatatatcctgacatcactgtacttcaagaaaacatgattttaaatagaccatattcaccatttgatagcttttagaaacttcctagctctattaatttatggccgtccaagttaaacggtactttcaaacacaagaatttctcttcacaatatattttgtttggaaagtagaatcttattgggtttacgatgagttcactctataacccaaccactaataactattttatatgatttgttttagtcagtttaagctgtcgtctttctcgttcggattcatcgaaaaaaacaaggagaacgttgtgactgacaaatgacaagcaggtaaaacatgaagcaaatggtgagcccttccttgttgcatccgtcttctactcctctaatgtatcatattgctcacaagtaaaaaaaaacgtcgaatacattcacaattaccatcgattatcactatagcgctccatttctcgtgcgacaagcacaatgagaaggacgatgacgatggtggttgtggcacctggcctgacatgatgctctttgtttcgatcaacaaggacgacaaggagaatgacaatggcggcggcaacaataacgaaaaaatgatgcttttttctaacttgctgcttattccttacggacagacgagatgaaattggggacggaaaaaaaattgtgcttacatatatacaaatgatttagatgggtttatagcctaacccaatccagcgcgtaaaaactagctagtcaagcggtttggttcattgggatacccaggttgtacgtgaacacctctgcataaaagatcattcctaaaatatttctaccgttggcctctctacatggagaaaattgttagtgtgccatcttcaaatatgggtttcaccggaatgttgtcttgcattttgattttgctaaattaccaatttcaaatagacattgcacgttagagtgccatttgccatataaatagactgaaatgtcctcgttctctgtttctctttcaactccgatggccttgctacactggcttgaaccgtcatcgtcacgtgctgctgaaaagggacatggacgagtacactacacctagccagcccaccgctggcaccccatcgtttaattgtgcaccgccaagctgtgcagtccggcttttctatcagcacgacgtgaaggccgccatgacgcacggagtgccaaagagagacatgtgcggggagttcgcaggatgacgacagatgtattatggagatggctttgattaggcggcacaactaggaagtgatgtgggttgagctgatgaagtggagcgcagtgcatcgtcggtgagagtgatggtggtcatggcattcggtggtgctgccgacaaacacattgacgtgtttaaaggaaaggagaagtgatgttcaagtgaacttttgtttataatagtattcgtatagacaatgtttaaaatgataatttaacgatatataacaatagacggcacaactatgaggaaacccttgttgaaagatggcaagatagcaattctatcctccaccttttgctgccgctctcgccataccgactcgtgtcgcacggtcgcgcagtcgcaccgtcgcggttcgtcccacgatccctcgtggactcgatccaaccgctctcctccatcagtgcccgagtgctagaccggtgggacccaacgccacaccaccggccgccgccgccgcgccgccattcgcgatgctccgcgccgccgtctcccgcctgcgcgcgcacctccacccccaccctcacgcccaccaccaccacggcctaccctccgtgacgcccgctccgctccgctccctctccacccgctggggcaagcgctcctccccgaccgcgtcgccgcccgccgactccgacgacgagggctccccgcgcggcctctccctgctcccccgcgaccctgagcgcccgccgcggctgctggtggtgcagccgcgcctccgcccgggctcgctcctcgactccaagctcgccgaggccctcaacctcgccaactccctcgaggagccgcgcgacggcttctacaaggaaggtctcgccgccaagggcgccccgccccacctcgtcgcccagaacccctcatcccgcggccgctcccatgtcggtatgtggcaatcttttgttcatttccagcggttaactcaagcgggagtgtatttaatcgtaattgtatttcgaaggtttaggtcttttctgcatgccggcatgcgatatgcagcgatttttatttaaattctggcacacctggggtttgttgtgataagattattagacgagcacttttagcattgtatgaatgaagggcgaattgtaaggcttgaatctgattgtttgaattttacttataagattattagattagcacttttagcattttatgaatgaagggcgaattgtaaggcttgaatctgattgtttgaattttacttataagattattaggttagcacttttagcattgtatgaatgaagagcgaattgtaaggctttaatctgattgtttgaattttacttatagactgagctttttggatggcacatactagagggctgtgcatacagagttgggtgagatttgctcatgagtactcatataggcgcattactctacctattcttctgtcttgagaaaacgggaaataaggctggctagattggcttgaggttatttctaattgcatctgttaaggttagggtatgcttagtgatgcaatacattctatagatctgccagttatttttactggaaatggtataaaataagtcatgtttctttggaagaccctcattggcatttctatgttgctctgaagatgtggttgtagtacattttcttagtggtgaagttgatttgtacctttgagtctttaatcctttcaaaatgtcaaaattattttctcctgaggtgctaaccactttcttgctaaatatgcgtagttttttgtttgcaatgtttgaacttcataacccagactgaattttctagagttcgatcaataagcaaataggtgaagtcttgagcttcactggttgacacttccagctgtgctatcaagtaactttatttgttagaactttttgccagcatttgtatagttctatacttctgttcacctaggagagtctttcgtcggcttttcttggattataggatttaaccttatgtgacaacttgtcatacagataaattttttggacctggaactgtggataatgttaagtgctacctgaggacatcggaatcagaggtgcactctttatttgtttcttgtacataaacatgactacggtgtaacttcatttgtagttttacaccccggatgatccattatatattccatttgtgttgtgatcgcacttgcttatgctttcttttctattgcacggtcaattccgacatgtatgatatatgaaggaaaatattccagtatgccttaagcgccatttatctggtattcctttgaatctaacaggaaggagtagatgcagtttttgttaatgcaattctcactggaatccaacaaaggaacttggaggcaagtgctcctgcttattttttgttagattttgtcgaagtttcaattattgtgccgcattctgaatttctgagcctcctgtcctttttgttcatgatgatatcttattttgcaggttgcctggggtaagccggttttagatcgtgttgggcttataattgagatatttaatgctcacgctgaaacaaaagaagcaaaattacaggtccattccattttgatatctgaccaaaatgtcactcttgtcagatcttttgagtgcatgtatatggttctctttgatgcataatattcatggaaatatgctgtgacatttggatatttgtttaattgctctattgttttgcttggcacagtcagagttagcagctctcatgtacatgaagactagacttgtccgtgtccgtggtccaggtggacgattaacttttggttcgagtggtgaagctgaagttgtaagtgctcgagggtatgtctgctcttaatcatagtcagcggtggtaaaatattgtttgatgaatgatgagcaaaatttaatgtggatgccatctttggtacaatgatattgtaatgtcaaggatgaactttaacctgtgctggtccacattttgaaacatggtaaacttgcatgttcttgtagttgatttcaacctgcaagatttcaacatttaaattgtacttatacacttatgtagtgacatcaacattgctctttgtttatatcgtttagaattatgaactcattttttatcatgcacaactggataatcatgcatattcctggtacggttgtaactgcagaagatgaaattcccactataagaaaatgatcactgggctgcagg

SEQ ID NO: 69577 - DNA, 5405 bp, Oryza sativa
acttgtctcagctgacatgatagtggcatttcctctgatggtttaattacctcctttctgatcctggatggaagcctaccgcctgttccagctttctttatgctttcaactacctcttttttacatcccctttgttgtgctaaactcttttgctctttctgattcaagagttttcatgccttttcttactagcaaagaaatggaaacattatgtttgtgattatttatttttgttttaccatatcacttatcaaatatccaagctaactaaaaatccttcagctagctatccagaaatcataccctgttaatttgtatggatgttgaggattttgcattgtgccgtccccaattttcctacgatggaacaactctctaaccgtgtttttcaataattcttacgtgatctttgattccaccaatcaaatatttcatattttatgttctttcctattgtatatgaatgtattaagtggctttttgggaatatctggttataaagggaatggccaaagaccatccggttcatgaaagaaattgaaatttttctcatttcctttttcaagagaagatagccccaaaaatctagtagggatttgttgttctagatctgcagaccgaatttgttgtttggtatatttaccatgtttgctgtgtgtgatatgtagctgagtatctaacgtcaggaatttacttgctgcagaatgcttttagaacaaaagcaatggaggttcaccctgatcaaaatcaagataatagaggtggctaacaactccatgctttttttttcttgattcgtcatatatatgtatcgtgttgttatgtatccacgaataccatgaacatcttatgttgtgcagaggctgcagaagagaggtttaaggaggttgtcaaatcatacgaagcaataaaactggagagaaaaaatgatgcaagttgaatgtgaatatgtagcttcactggagctcattgggaagattgaaaggatcaatgaagacagtatcagcaggccttgcaatcaagtggatgatctgttaggttcggctgtatctgttgatagcctgtaagcacaagtttttatttgcgagtttttttttttgggagcacacggccctgatgtagactaggatattgtcgacaaaggtgcaaaaggaaattgctcatttgtgcttagccactaatttggggtgcaaaatctggactgcgggtgagcatttttgttgtgtacacctgctggtttattttttattagtagaaagtagagtgaagatctgatagaaaataataagtagcccataatattatagcagaaaaacaatgtttattacgacttactcagttactctgttgtgcattagagctgtggttagctcaaaccggtgctgcctatcatctatatgcgttaaatgatgcatggatatgaattcggtttgttacagctgaccctgttgattctgcacagcagatcgcagtatcagactgaaattgtgagtgcaatctagccataaaccaacatgtcactttcgaaatgacaccgtatgatcatactctgatacgtggagagtactccctccgtcctataaaaaatgaatcttcccataaaaaatgaatctgatttatagtaatagaatatattaaatctggtactaagttgttcctataatcatgttgccacgaaaaagaaaaataaaaaatgaaccaaaaagaaaagaaaaatgaaccgggcaagcattctgggcttgcgcagttgcgccacactgccacagtccagcccaccatgcggcgcctcctctccgctccgctgcgccgccgcctatgcacggcggccgtggccgcggcggcgcccgacccggccctcgcctcctccgcggagctcgcgtaccgcctcctccgccgccaccactccgaccccaagaggctcaccgccgcgctctccggctcgggcctcgacccgacctcgccgcgcctcctcgacgccgtcctccgccgctgcggcgccgcctccgcgctcgcgctccacttcttccactggtgctccccgtcgctgccgccgccggggccgctcccttcctccctcgcgctcctcgccaagtccttctcccgcgcctcctccgcgccgtccccttccctcctcgcgccgctccccgcccagctcctctccccgtccctcctctcccccgtcctccgccgcctcccgcccccgcgcctcctccccttcgcgctctcactcctctccgcgcgccccaaccacgaccacccctcgctcttcctctccctcctcgagtccctcgccaagaccggccatgtcgccgtcgccgagcagctcgtcgaggagctccagcccaggctcccgctctcgctccgccactacaccgcgctgctctacgggtggtgccgcatgggcaagctcgacgaggccaagcacgtgctcgcccgcatgaaggccgcggaggtcgccccggacgtcgtcgtcttcaacaccctcctcgccggcttcgtcgccgacgggcggttcgaggacgcgttcgagctggcccgggagatggagcggcgtggctgcccgccgaacgccgtgtcgtacaccaccctgatgcaggggcttggcgccagggggagggttgatgaggcaatgcgggtgtttgtggaaatgcgcaggaaggggtgtgcaccggattccgtcacctatggcactctggttactgcgttctgcaaggctggtaggatatcacagggatatgagttcttggacgtcatggcaagggagggtctgcgggtggacgccggcgtgtacctcgggttcttcgtcgcgcacgagaagaaggagcagcttgaggagtgcttggagttgatggagaggatgagggagtgcaggtgcccgccagacctcagcatctacaatgtggtgatcaggttggcctgcaaactcggggagacgaagcaggctgtggcattgtggaacgagatggagaccaacgagcttagtcccggggttgacacatttgctatcatggtgactggcctcgttggccaaggcgtgctggttgaggcctgcggttatttcaaggacatggttgggaggggactctttgttgcaccccagtatggggtgctgaaggacctcctcaattcattggtcagagatcagaaacttgagcttgcaaaggatgtttggggatgcattatgaccaaaggctgtgagctcaattttggcgcatggacaatctggattcatgcactgtacgcaaagaaacacgtcaaggaggcctgcatgtattgcttggacatgcttgacgctggtctgatgccgcagcccgacacatttgcaaagctgatgaagggactgaagaagctctacaacaggcagattgctgctgagatcactgagaaggtgaggaagatggcggaggagagacatgttagcttcaagatgtataagaggcgtggggtgagggatcttgaagagaagcctaaggcaaagagaaagaaagggcagaaaaggagtcgcttgaggcaggctggtcagaatcaatccaataggcatgctgacaaaactgacctttttgatgattttgatgatgaataatttcatgcaaggactagtttttgccttctgatagttgctctatatagtttcgacttattactctagatcattctgtgtgaggtttaatattttttttcttggggaatcactggatctagattgtaaagttgctaatccaaacaagtcaataaacatgtcacaaaaaaatatattgttttttttttcatatgcaactagagcgaactgtaaaatcttacacgtgcagagaaataggtagtctgtaatgatctactttatgtctcttaagttgttgcatgcagtatgattgtgatcataagtatatctcattgtaatttcaatttgtgataactggtaggttgatgtatacgtagcagtatttcttttcccaagtttgatgggcattgaatttctctggtttcattatatattgtagtttaaagtatcacgaatagtattactttaagttacatttgtttaagtatttcttaattgaattcctcccttaagaaatacggagtactgcactaaagtaatgttctttgttctagggtggtgaggagccgaagaaacatggtttggttttctattgttcgtttggttaagccaacaaaaaccagatcgggtgttttgactatgtgtacctgcggaaaacgttggctagaagaagaaaatgactgtttgcctgaaaattgggatgaatacatacatttgtcgtgtagtaagaccccccttaaaacgcacgatagaaaaacacaataggttcccggcgaaaaaaaaacacaataggaaaaaaacgtaataattgaagtattatgtttttccaatcctatgaaaattgagaaaaaaatatatataaaaagatgagtaaattacacccgcggtacatgaacttgtgtggtgggtgcaaatagatacaacaacttacaaattgctcactttgatacaataacttggctagttggtgtgaaccgggccaaaatgatccacacaagtaaaattgctctaaattagtgcacactaatgacataacaacatatacatataactgtgatttggagatcttatttcgaatccaaataaaaatgtgcaaaagtttatttttcatgtccatggtacaatatttgtttcattttttggaaaaatttgatcatctatataactcgtctaatgtttatttatctgttcaagaccaagacaatttttatatgtactattaactactaaaagaaaattttaattttcatgttcatgttctgacactttcatcgaaagtgtattttaacaatcaggtatttttaattattttgctttttcgttggtctagatcttaaaagtatcatgcgactaataatatgtgtcagtaaaaaattttgatgtgtaacaataattacacactagtacgtatcatattacatcaattttacttgtgtggattagtttggcccatctttgtatgaactagccaagttattgtaccggaataagcaatttacaagttattgtacctaattgcacccaccatacaagtttgtgtatcgtgaacgcaatttactctaaaaagatggactctttgattgcatcacaggaaacattcaacaatcaacgaagaaaagtttcacaagagatctaacctcttatttattttcatatggaattgaccataggaatggaatcctatggaatcaaaggactctagaaaaaaatccttcaaaattactttgctaatcctccatttcaaagggtccctaaattaccatttggacaagatttttaacaaagtttcactttgaagtctttgcgctattctaaattctatattttatataataaagctaaaagt

SEQ ID NO: 69578 - DNA, 2508 bp, Oryza sativa
attcctgcagcccaatttggctcggagaaaatgtaatagtagtatgagatgttatttctatatgaaaaataagactatccatcatttattcttgaagtgtcattatgcaaaaatttttttgaagagcaatacatatttctctggtttgtattcttcacatagtatatctcatatattagaaattgacttgtgggtattgataaaaaaaaccagcaaacttattctcgtaggagcatccgttgggctttatgattgagcagaaattatatagtttttgacaaatcatcatttatatcttatatgcatgttcttctcagggcaatgtactgactccggttctggtctcaattataaaagtgtgacgatgataccaggcaaacaaaaattgcatgtcacgaacttgagtaaaaggtaatgcagtttttcgccaacttcaaatgaagattcatatacaggattcaacaattaagaggtttatttaggtgttggcgatcattaatttgtgtttgcttcagtttatctaggtgtgttttataagacttgttgatgtgccattattattgagtgaatttgtgtaatatttagatataactcgttgagcaaaataccagaattttatttcattatcttaaaaaaacagtcaaagttggtataacttgttcaacgctgtcagttttaaaaacggggataaggtatctcagatcttgtgctctactgctctctcattggagcaaagaggttaaagaaaagcttcgagatcccccaaaaaggatcatgctcatgtcctcgtataactttataatgacatcgtgacagaaaccaaatgctactactacccaaaaaaaaaaaaaagagcatagaggtggggctcaacatgcttcatgcgagtttatggtgtttgtgcagtggtgtacagctacctgggcacctagcaaagggcagaaatccgttgacggccacaagttttgcgatggcaaagctcattggttgaaggtgcactaatgcacaaaatccaggattcgtagctaaaagacagcgattgaccagcagcgagtccactgccagggggatactatacgaagttgtttgggacatgattgtcttaattgggcggtgctttgtttaagttaatctatcttttgtcgcttcacgtagtatttttaatgcaataaaaggctcccttcacatttcgtctttgatctttaatcatcatcgatgacccaagatcacacctaatggaggcggtggatgctctttggttggaatctgatggagagttggagagtggagacgaccctgttcaatttaatatctccaatgtttgcacatatcatgtacggaatgcataccctaccaaatgctgctatttacacaaaaccccggatactatgatttatgtttaatttgtaaaaacccacatgaactttaacatgtactcccttcttctcaaattaattatcatataagattatgcaccaaaaataaggacaatttaagtcacattaatcaagacaccatgcacattcttccgcaatgcatgcatcaattaaaaccccataccaattacaccctagcatgtgcatattctcccatactgcattaattgtattccgatggaatccgtatccatatagttatatggtgatcaatttgagaaattttgaattatattacatgatgatcaatttgggaaggaggtagtatcacataaccacgagtatttaggtgttaagctcttattaaaccgtaatgttaatcaatccatcttattactgtagcaaaataaaaattaatccacgtagaatactacaacatttatacgacaaacttaaaaaaaagctatatatttcagatataattttggaacttataagtattatatatttaaaaaataatagtggtagtgtggttttataaaattaaaaagtcatagtacccatgggtatgtataacacatcgctatgattgtctttattatagagcatatatattatattatctgaggttttctgaaatttattttttaaaaagaattttctgaaatgtactcccgtgggaaacgaaaattgcggatgaaattcttgtcaccatcggattaaatccgctatccttacccaacaaaaatgacctctcaggtcagacaaatcggtttttctgcgccgatatccgcattgacgtgataccagtttactaccgtgatcctaacccgtcctgcgctgcgcggcgcggctcgctgttgcgtacgttgcgacttgcgagtcaaatacgttgctcctccctccgcaccgggcggggggtccccgcggcataagtaaaaaagcgaccggcacggtgggttcccgggctgacggcgcgccatcggcaagggccaaaggaggggctccacgccgcgctgccgcgctgtgcctgctgctgcttgtgcgcagcgcgcgtcgggggcggcggccgcgcgacgcggtggtgcagctgcctgtcgctcgcggcctcggcggcgtcccaccacgcccg

SEQ ID NO: 69579 - DNA, 1534 bp, Oryza sativa
gggccttgggcgtggcagcgccactttcgtaggctccttcctcgggccgtggcaggggtgcgggggggcgtgggcgacgacgtcttctcttgctagttgctactgatccgtgctcgtaatcgtacgtactgcccgtttggtcgggtacatgtacatgtactagtacgtgacatcttgcaatccctaaaagacttttttttttggaagaaccaaaagatagtgaactgcatgagtggaatcctataggatagttaacttgaatctgcaaacatcttaccaccaatcgggagattcagagtttcattatatgcagatgttgttgccctttctgtcacccctacatacttaaatcttttcgcttctgtaagtgggatgcacatttatttgcaacactcaaaagtttctgtaatttgctgatggatataatatcactattataggacatcctttaaaattaataatttgcctgagaacattttcggttcgattggagagaaaaattctttaaaaagacaagaatgcccctatgaccaaaatcttttaacctatagtgctggagtgaagatgaaatatgatgcatattctaatctatttgaaaattttatctctctaacagatcgaaagtgtcctataacatattactatttgtttatgtcttttagccatcacacgtttttacaatattcactagtaaattacataatctttgagtgacctatagcaaaaattgtctttaaaaaaaagagagatatacccaatctcctgcaatgaactaaatgtagaggcacgctttacaaattttcctggaaaggtatcaacattgtcatgcaaatatctagtacattatcaaccactgactataaaggtatcaacattgtcattgcctctgactataaaaagctgaaaaaacgattatcaaccactttttgacaagtttggcttcaaattagctggatggttaggtcgcttcttcacatcgtctagcagaaagacgctagtaaaatcagttcttaatgtcccgcctctctgataccgggtccacttacatctggcagcttttataggttataaactgctctcacaaactaacacaaatcttttctgcacactttgtcctcactcgtgcgcacttgggaagaatttcctgatcggtcgcccatcccaaatctgctccaagctaagcatgcttaaccttagagttctttcgagatcggcttccggaaaagaagttgcaacttgttgatatgagtattctattaatcctattaatccctgggccgggatgtcacagcaagagaataggctggattagaggatcctttctttggagaagtgatgacccacaaaatgtcagtggaggccacttcttgattaattggttccaatggaaagatcccgaaaaaccatgagtttatgaatattccctgtgataaaatagacaaaactttttaatgcctgcaccttgatcaccgcaagagatggagagaaaattaaattatggaatgattactaactgcagaacggggtgcaggaa

SEQ ID NO: 69580 - DNA, 2872 bp, Oryza sativa
  unsure (1)..(2872): unsure at all n locations
ctgcaccccgcagattctgaacagtgctcgtctctataccatcatgtattacatacttggttgtggaggacacctcggctaatggattgttgaggatatctcggctaatggggaaaatatgcgatggaaacaacatatgcagtggaaacctgaaaactaccgtcggatcgaaaaatggacgtctgagattcttccacgttatcccgactaaaaattttactcgcagatatactcatgtagtaattttttttatcatgcgtctattttttatctaacaatcgttttcaggtttccactgtatattttcccaagctaatgagtaatgaaagttagggtttgattaaaaaaataaacaaataaatctcattaaccgaaaattgcaacatactccctccgtcttaaaatataaacatttttggttataaatctggagaactatgtgtctatatttatatatagataaaaattgatatattttgggacaaatgtagtatgtaaataccgcgatgggtctatgtgcgtgctacgtgtgcaacttgtctctctagaactgaaaactgctaaatcgaaacaagctggggctactgggctttacacctcaggaatgaatcgaactgtcgtggccccataggcccatagcacccatgggccggggccttcacttcattttctctaccatagtatcgccgcaagagaaaatcacgcgacggcgacagagaaacagcaaaatcacgcattacgcaccaggagaagaacgaattctcatcgagctcgattgctcgtagtagtactaataacagccctaaatcgcgacgtgcgcggcgcgggggcgcaagacaaagcatacacaaggacgtgcagggagtaggggaacccgtcacctgagcctgtccagagtatacgcgcgcgcggccgggtacaccaccctgcacgcccccgcggaacacggcgaaaccccccgtgttccctcgctgcctctcccggccggccggcgatggatagggcagcngncacccccccccccccccgccccccggcgcagccccggaggatgcagcactgcacgttgggtgtccaagtactctctccattctaaaatacgattactttaatctaaaatggattaagactctgttgagtttgtgattcaaattcaatcgcacacgtaagctgtcattcggtgttgtaatctcacctgatataatgaagatatttgctggctgatgcccgtggttttttctctcttacttaagaaaaatattccatattaaatctcgtgtcttctattattaatctattattttttatcatttatttacctatcgttttctatcagactcatcgtataattatgaagctggacattgacggcttctggccgatcgacgtgcgagcggtcgccgcatttacgcgcgcggtacgacaaattctctcgcattcaaagcaccgcggcggcgcggcgcttgcgatctgagtttatcaaactacggcgtgtggtggtggccgtcgacttgatccgtcggtccgcgtcagactacggatgcagcagtgggtgcctaccgcctttagcttcctgcgtaacctcgcatgggatggcaccccacccacccatgctgcagcgccccaaagcccacatgggccaccatgatcgcttgtagggaatgatactgccggccggtgtgatgcgtttacctgcgtatgcatggcatgccccagtcgcacatgagatagcaatagacttcttctcccagaaaaaagaatatcagagagaagattgcggtactagatatgtgtattcatgtttagaaatgtacactttatttggacgaacacacacatacacactttatctttatgagcatatgaaaaatccgaccaacataactttaaggaaatcactatggtgtcgatgactacattacttattattgaaaattaacggtattaaatgtgtacactctcagttccaaaataaaagaattaagtattagatgaaatattttatgatacaatgaattcagacatcctctatcacgattcattatactagaacacatcacatctaatattagattgattttttttgggacggagtgagtacattcatgtcttcaatgctccatacatttgaaaaaaatttagaaatatacgtattttctgtagaatttgcaagaaaataccgaacgcgtgaagatttgcaaaaatataccgccgtcgcggtttcgttgagcgagaccgcggtcttacacgattgaggcgcgagaacgagagcagtatcgctcgttcagtcagcgaggacggagcgcacgcggtggcctaggcggtgctatgatatcgctttgccgaatagcgagagcgcacggtgtcgcactctaaaagtgcgagagcgagccggtgggcccccgcaaatgttgcgactgcgacccacgtggtctcacgctacaggaacacgagagcggtgggccccctgactgcgatggcgcggtctcgcgctagaggaacgcgagagcggtcaggtgagccccactgcgcgcctaagggcaagtgctatggtagatgtgactaccaccttcaaatttatctattttatttactcatgaactaagaggcaactcatacaatgtatcacctctaatacacaaataccaatttctctaatactctcacatatttcttgaaatttgtgtggatgttgcctcttaatttagaggtagcttatcttctctctcctcacttctctcctccacctcatcactcaatctaatgtggcactcttaggggtaacatatgggagactatagtacttgccttaatggtgttaaggttaagttaattacatagaaaacttcgtataaaaataaattaatcacgc

SEQ ID NO: 69581 - DNA, 2142 bp, Oryza sativa
cgatggtatatttatgctaatcgaacaacatccagtatatttctgaaagaaagatcaatgaacagtatattttcaaattttattcccatacatttaacgaacattcaaaacgcaagaggtaggcataatccatctctctcccggtctcaactggactcgatcgacgacgcaggttttgactcggcatccctgtgttgtgaggggccatgttggcaactaggcattcatgggccacaatgtcttcggtcggttttgcaagttaacgatgcctttaaatgggtcaacgagaggggggccatgtctcggtcgcgaaactgattccgcgagatgaaggttcagtacccgtcccggacgagagcgagtgagcgacgacgcccaagaaccaacaccggtggctcgtacaaattattacaactggtaaggtggcacgtataattgcctcagctaattatccctccatttacttttgatagtcatattttatattggcacatagatcaaagataagtaattccatttatcatccatttaaacatgctaatagtcattcctcgtaaacaaacgattcattaatatttacatttctcgataccatgtagccaatcttgtgtggagaaatagagagtcacgcattaaatttaagaaaatcattaaaatgatagattgttggattgaaatatgcctatcaaaaataatttttttagatttaaaaatatgactatcaaaagtagatggagggagtaccaatacgaaattatctaaattattttacacgtaaatttatttgaattttattaaatagtaatctcgttgtcttagtattttttgaaaaaaaatatcgaatttgatcatgatcaggttttcaattttatactttctccatccaaaagtcttttactattttactatttgcttttttttccaagatgagttgagtgtatttgtattgtgcatgcgttaaagcttttgaatccacgtgactgtttgttaaacatgcatgaaagtagccttcttttgcatgaggtaatccatctgttgcactgttttttcatgaacgcgcataagacaaagtttaatagtatagcccattattagctctaatttatctatagccaatctaatagccaattcatataatagttgcttactatactattaatatatggtcccacctgtcatacacacattgcgtcttggagtccgtgttgcagctggctacagatttatagcctgctgctcttctctcttatcttttatctcattaaaatatgtttacagctagctaatagcctactattatacctgctctaagatcgtgcataagggtttttagcacatactccctccattccaaattgatctacatatttcatagctacaccaagaccaagaaaagctaataactctctcatactatatttactctagcaacaaactcaatgcatgcaccatccccaatattttctagccaatagcaaatcaagatattgcatgtgggttataaatacttgtgtgcatggatgcatgcatcaatgtccatttactccaatgcacaaataacgaatagactctaataaatgaacacaaatatgtagatcatttaagaataacctcaaaaaaaaactagatgtagatcaatttggaatggagggagtaccatgtttaaagagagaagactttaatgctccttaataaatatgaaatggatggagatgggagggtgggtaggggtaacatggaaaaagaattaaatgcaaaatggttgatgagacaagtagtaatatgaatagtgctaaaattccttatattgtgaatcatgatttaaatcctataaatttttatattttaaaatggaagaaggatagataaatagatagatggagaaaaaaaatctttactagagatatgtataagcttgaaatatattttcatcaaatcttaaaatcttaaattcaaagtcaactttatttaagagcaacaaaatgataaatttatagtgaatagtaagagggaactattcatatgaaattgatttttttctcttaaatgaaattatgttggacttcagatttggtatcgacaaatttatagaacttttaaatatgcgtgttttttccttatttaatacttggggtgcaggaa

SEQ ID NO: 69582 - DNA, 3384 bp, Oryza sativa
attcctgcagcccctctttgccacatgaatcaaatgctgaaaatattagtatgcgaatttcatatagcagtagaacataaaagaaatatgacaaaatacattgaaaactaaaaaaattaactgtgctgagggaggcaaaactaaatgtcatttaatgtaaaccatcgttagggttgtactatacacagctttagtttcaggaggtaactgtttttactgtggcaaagggctctatagctatatgcagaacatatgtaaactttagcaaggactctgggtcaatgcatgtgactttaatcttcactggtccacgtagtagttcataacagaattaagaaaatcgatatttttttagtacaccacagtttttttcccctcatatctctgcctcatactaatccacaagttaaataaaacctggttatgctatgcctgaaggcttcccccccatagtcaagactcaaaaccacaaaccttatttactggtggattgtagaaggccaaagattatgtagaactaacatctaaacatttcttaatctgtttaacctgaactataaagaagacatcatgcaaagttgcatattcattgcatataaagccagaaatgggtggacatatttagaaaaaaggcaataacatacctactgttctgcggccttttcaccaaccacagaagaagatggtctccattttctatcaaaaggcccatagcttctctccacaatagtttgccgctcggttagtttcttatctattagctccagtaactcttgcaatcctgtccctgtcactgcagaagttttcacatgacaagtggacattggttgtgttgaactgcagctatctgtactaatagtttctggaccacaaagctctccaaaacaatcttttgatgatgatgatactgagttcattgctctcatctcactaggctcaagtgaggatgatatttcaccattgttgccttccaaattttcctctgataaatattcggagtctgttccatcatccaaggactcaaatgatgattcttctgcaggcacatcgttttcagaaaataattcttcctccttatcctcctcaccttcggtcaggaaaatctcatcttcaatatcatcagttacatcattatcattgttgtccacaatatcaatctgaagaaacaccataaaaaagtcaagttacatgaaaacccatgctaccaacaattcaccatgcaagtgtgacagtcacagccaaattaaatttcactactaaccttattccaaacttcgatcatactgttgattttatcctgtgaaacaccaatctgttgcaatacttgcagaacagtagaacgatgttcctcgatattaggagcactagaatctaatacatgctgcaccaatgcaaataaagagacatacaatcaactctatttctcttttttttattaagtaatttatcttaaaacaatttctgaaaagaaaatgtacatggctgaagaactatttgttattaaactagcaatggaaagattttagaagctgtcggagatatgggccgggggtatgcaaagtgaggggaagttaccttcccatccagccacgtggctctacagtctggccctaccccgcacctcgcgagtcgcagaagcggccggggcgcctcggggcgccacgtcatgcccctcgggctctcgcgttgccttgccccgaggccctcccccggctgccatgtggcgggggagcgagaggggaggaaacccaggctgaacagccatcaatgcgcggcgccccaactgtccctcactgcgtttaatgtggtaaggacggacgtgcggtgccgcaccactgacccacgtcaatcgggtctgaccagtctgtgatcggcctgtcgccggtcacgttcgactgaatgggcggccgtgcccccacgtcgcctctgtatccggcggagtggaggtaggtatgtcccgtcccatcgaaaagtcattcggagttccctccgtgagaggaggaccgccacaagtcttcactcatttatgagggaatgacagggctgtcccccgtgtcaggctggggggggacgttgggtcccgctcaaggacggactgctgcttagcttccgggcgaaggtacgggtcgcagtccggtcaaggtagtgggtccccctcccgtagaagagtaggcagaggcggtgcatgcggtatccccttaaactatacaaggatgaccttgcccaccgagaaaagggacgactctcagtaagcctgaactctaggagaagagaagtgggagcgctctccggagtttaggaacccttgtaacactccataatctcacacacaggagtagggtattacgctccatagcggcccgaacctatataatcttagtgcccacacgcgttttagtagcattgagggcggattcacgatctccccacgcgagccttttcccccggccgaactcactaaagggggatctcacgatctcccgctagagaggatcactcctcgacagctggcgcgccaggtagaaggaattcgcgcgcttcaaagggaagtcgtttccttccgccccaagttctcctctaccttcgacgatcatggtcgaggtcttggaggaagaggtggtggtgcacacccccattccctccgggagtgaggatgctagcgggagtcgcggcccccgtcaccgtcgccgcaactggcgaactccgccccgtcgcgaccccccgcggagggaggatcccacccggtcgggtggctcggccctctccccgcctcccggcggggggaggccacggcgcgtcggagcacgtcgccgcctgacatacggcgacggtgactcgccccgaggcgcgcttcaggcggcgggagcccttctacggcatcctccggtgaacgcggagcatcctcaggttggtgacgtcgccaacctggtcaccactgcccagcgacagctgaccgcgggtggccgttccaccgccactggtacgtcacgtacccccaccaccctctcctcatcagcaaggaggagggcccgtcggtcggccacggccttgaggcgatccacggccccaacgtcgtcgggggcctcgggaagtcggaggcatcacgatgacctctacgaggagcaggacgctcgaatcaacatcgagcaacaccgggacgagcgccgcgctgcccgcatgggagaaggcgcctcctcgtctggagtgccgcgttcctcctcgcgaggcggcccgccccccacgttcacccctggagggactgcttgtagggccttcgttgtgagtctccggaatgtccggtgacccccgaagttttgccccaacctcacggagaagtatgatggcagcatcaatccctccgagttcctccagatctataccacg

SEQ ID NO: 69583 - DNA, 9446 bp, Oryza sativa
gggaggggggggacgaccgggtcatggcgaattatttccccatggctcttaagggtcaggcgcgcgactggctcatgacccagccccccgactccatccactcctaggaggacctgtgccagcagttcattacgaacttctagggcacgtacccccgcccaggagaggagacggacctgcatgctctgcagcgaaaggacgatgagcccctccgctcgtatatacagcgcttctgccaggtccgcaacactattccgtgcattccggctcacgcgatcgtttatacgtttcggaacggcgtgcggcacaatcgcatgctagagaagatcgcctccaaggagcccaagaccaccgccgagctcttcaagctggcggacaaggtggctcggaaggaggaggcgtgggcctggaactcccctagcaccggcgcggcagctgcggctgcccccgaatccgttacccgctctaagcggcgagatacgaggggcaaaaggaagccagcccgctccgacgacgagggccacgtccttgcggccgatgggccctcacgggccccgcgcaaggaaaaagccaccggcgataagccgagctccaccgctccctccggagagggtcggtcggcagacaagtggtgctcggtgcacaacacttatcagcacagcctcgccgactgccgctcggtcaagaacttggtcgagcggtttcggaaagccgatgagaagcggcagaatcgacgggagggcaaagcccccgcgacccccgccaatgactggcgaggggaggccaagaagaaggcccccgccgatgacggcgatgatagcgaggatctggaattccagatacctcagggaaccgtcgccactctcgacagggaggcttgcgctcacacctcccgccgcggtttcaaggtcacgaggtgtgagcttctggccgccgtcccaactcacaaggcggcacggaaggcgcgctggtcggaggtgaagctcaccttcgaccagagcgaccatccaacaatgctcgctcggggagggaagttggccctcgtggtctccccaaccatccacaacgtcaagatgaagcgtgtcctggttgacggggaggctagcctgagcatcatctccccggctgcttttgacgcgctcaaagccccggggatgaagctccagccgtcactgccgatcatcggcgtgacctcgggacacgtggcctctgggtcacgtttagctcccggtgaccttcggcgactccaccaacttctgtaccgagcggattgacttcgatgtggcggacctcaatctgccctacaacgtggtcctgggcaggcccgcgttggtgaagttcatggccgccacccactacgcctacctccagatgaagatgccgggccccagcggccccatcaccgtctttggcgatgtcaaggtcgccctcgcctgcgcagagtagcgtgccgacaacctggcggcagccacggagccgcaggtcccgaaggcctccacgtcccgcgcctccaagaagcgcctcgcctcggccgacgaggtgcccgtcaaggagattccccttggcgatgatccatccaagaccgccaagattaacggtaccttggacgccaaataggaaagcgcgctcgtctccttcctgcgggcgaactccgacgtctttgcgtggaagccgtcggatatgcccggggtccctagggaggtgatcgagcaccgcctcgccgtgcggccggatgcgcgacccatccggcagaaagtacggcgccaagccccggagcggcaagccttcatccgagaggaggtgacgtggctcctggaggccggcttcatccgagaagtcatccacccagagtggttggcaaatccagtggtcgtcccgaaggccaacggcaagctccggatgtgcatcgactgcacggacctcaacaaggcatgccctaaggatcccttccctttaccgcgcatagatcagatagtcgactccactgcggggtgcgaccttttgtcgttcttagatgcctactccgggtatcaccagatccgcatggctagggaagatgaggaaaaaactgctttcaatactcctgtagaaacctttattatacaactatgccttttggtctcaagaacgcaggtcctacttttcagcgcatgactcgcattactttgagtaatcaaatagggcgcaataggcgcaatgtagaggcgtatgtcgatgacctggtggtaaagacacgccaccaggacacgttgttgcaggatggctgagactttcgacagtcttaggtccacgcgcatgaaactgaaccccgaaaagtgtgttcagtgtgccggcgggcaaactcggttttctagtctcctcccgaggcataacccccgcacatccttcggcttgtgcaggcttggccgagggctaccactgttaattatgttgtatcttttcccttccccagcaataaatttttccgctcaagcggaggctattgcgcgccctttcttactccttcctatggctcgtcctgcttcaaaggatgattcgcgcttatcccggaccctaagtggcgttgggcgacctgaaaaccgccgaaagggagcctaaacgcgggccgcgccccgggctgcggcgaaccctgggggctcggaagggcctacacacggccatccccgacccccggtcgtcgtagcctcggtctggccagacctgctaggcagctccctcggggcgacggcattgcccctcgccacctaggtgccacgggccgagcgtgagtttcccttttcaccggaacaagcccgaggagggacataaagagggtaagaacggcaacttaatcataagaaagtcaattgaatacgttcgctttggtttcttcttctttctttgccgcagacattcaaaggagaaagcaagaatgtaaaggcgcgaaggagaagctttgtttacaaacagtatggcacgatgacctaaagtttgaagcgttcaccgcgagcacataacaaaataaaagaagaaaagcggggatagtcacggagtgcccgggaccccgagtccggcgccgctgaccacctcgtcccagtcctcgccgccgtcatcgccaccactgtcctcgctcccctcccctcgtctgaagcaagcgcaaggttgaaccgaggggccgacccctcgaagctggagacgatcgcgtcggccgcctcctggacttgctcccgagccctcgcctcggtccccggggggaagtcctcgagcgcgcgccacaggacgaagtcggggtcgcgagcttgatgacttgcgaggaccagttccaccgcagcccgcgccaaagaagccgacaacgacttcacgacctcgccgacctcctcctccagcctctccaaatccgcagccatcccgtccagccggagcgcgagtgccggctgtgtgggcgggagcttcctgtcccgacgcacggagatgcctacccggcgccccgcgcactccagccgttcgacggcgtcggagagttggccaggtccgatctcgttggtgaggcggagggccgcaatctctccagcttggtcctgcaccaggagccgcaggtcggcgagggtgctttgaaccgcggtgagttggctcatcaactccgcgccgccgggctgcccgcctgccgccagctccttctcccaggcctccagctcggaagccctcgccgccatcgccgcgcgctcagcgcgggcaccttctaaatgccgggcctcgcgcccggcaacggcctcctcgcgtttcgcgagttgctcgcccagccgacgcgccgccacctcgcggcgattcacctcggcctcgcgtgcggcaagcgcggtgtcccgttctcggcacgcctcctcccgaagccgcaaccccttcgcgcgatgagccaccgaagcctctgcggcaagggtggtctggttgcgctcggctgcggcctcctggcggaggcgaagggaggactccgcctcggccgccgttctctcgggcggccaaagtggtctcgcgctggtctagcatgcgcgcccgctcctccagcacccgagcatgctcctccagctcccgggctcactgcgcctgttcccgactgcgcccgtcctgttcgcactggttacggtcgaggacctcaatccgtcgatggatcgtggcctcgaactcctgcgcggagcgggcgcactcgtctaaggccttgcgattggcctcgagcgccgccaaccgagcccgcagcgaggcgtcgacctccgacgcccgccgctcttaggcagcagccgcgtcgaggactccgcgggcgtcttcgaccctcttcgccagatcctcggcgtgggcctcgtactgcaagcgaatgtcgcccagcgcctcatccagtacgctcgaagagataagcaccgcctgccgctcctcctccgtctcccgcataaccgagtccagcgtctcttcgcgcgcctagttctccgccagttgggcttggcgcattttgcgccccacctccaccatgtcgtccacggcgcggcgcccctcatcgactcgcgcgcggtccgccgcgagctgcgcccactccacctccagggccgcctgctcgtccgctagggcttgaacttgggcattgagcccctccaggacggtggagtcggcagcggcgagcacctgcaggagtggctccatgctcacgggagtcggagaagaaaaagacggtccgcccccgagatgacggagtgctgctggaccccccgcgagactgggggctgctctcggcccctcttccgcgcggccagccccgaggacgccccaaatgcagaggggaacggttgcccccgtcaccccccgcctcggcccctcgggcagactcggcctcggcctcgagttcgggcccgcccccggcctcagcctccaggccgtgccccgcctcggcccccggagcgtgttccacctcggactccgagccacgacctgctttggcctccgcccccgagtggcgctcctcgtaggtcgcgccctcgggatcgcccccggggggacgccgtcgccgttgctatcacccgcggatggttgcacctcggctgtggcgggctcggaaccagacccggcgtgtggcccgggggccccaccagggtactgcgaaggccccgtgacaccgggttggccgggtcccggtcgatcccaccgctcggattttgacccctacaagggatcggacgccgagaccccctgggaaggaatcccgctacaggagaaccccaatcacgttaaaaaaaaaagaagaggaaggaacaggaggccgagatggatagagagcaccgagtcggatgctggcgatcattcctgcgaggagggcgtttgaaggtccacttccggggctcgatgaagctcccccggcacggctccgtttgccctatcttccggagccgcttcttccgtccagcctcggacgcggcggggcgtttgtggcccgccggtggtcggtccgccgttcgctcggcgccccctccacgcgggggagaaggcagccgagattcgaacgccttccgcttccctttcgggtcgccggccgagtcccccccgggtccatggctcggaccgggcgcccaggagccgacgcccccgccggagccgccggcccggctgccgcctacggtcgcgccgctgctacccgcgccgtcgccgccaccaccggcgccgctccggcgggaccgacccctgccagcaccgactgccgacatcacagccaggatactctcccggtcgcggtcgctgcagagggggaggatcccgtccggaatcagcgtttgcttgatagtgtccaggcccagcactcgccggatcaccgtcttcgcgtcctcctcgccccagtcccagcgctcacccacgtgggtgcgcatgggatcgttgtgcccagtatactcccacgcgccgcgggaccgctcctggagaggcgcgatgcgacggcggtagtcgccgaacaccatcgcccccgttaagccttagcttcgcaggcccctgaggcgatcccgcacggcgtcgtactcctcgcccagttccgaaactgccaaccacgcggcggatcgttcaggagggccgacggggagccgaagtcgcggatgatccggtagcgcggtgtagaaccaatccttcttccaatcctcccacttcttgcagaggtggctctcgatgtactaccccgccattcccggccggggctggaggtagcatcctcccaccgccgcgccttgctgcagctgcgggatgaagaaggactggaacagccgcatcgtcggccgcaccccgacaaacatctcgcacaagtgcgcgaagatgaccagcgtcatcacggcgttgggtgcgagatgcaaggcttgaatctcgtagaaatccaaaacctcatggaagaacctggaaaatggcgggatcaaccccaccatggcgaaggacaggaggtgcacggatcgctctggataccacggccgcggccgtgactcccccaccctcacggcggcgtcctccggcatgatcttgcggacgaggctaagatgcatctctgccgtgatgcgcgacgccgggagcacagcgtcaccagcgtcatgggccatggtgaccggcggggaaacgacgaggagcttggtgtacagaatggcgtggagcgagagaagcgatggggcttgaagaacgagtgagcgggcgagcagtcggcgagaagaaggggacgaactcgcccccttatccttttatccccgcctcgcccgcgctcgtctcctcgtttcacgcccccgcggttgtctcctcgattcatgcgcctcatcgtttctcgcgtccactcatcacgtcgcccactgaatccgcgccccgcgttcagtgaacctgtcagcggcacactcagcgcggggcgtgcgatgttcgtgggcgcggattaggcgggcccgccgtcggtcccgtcgcgtgcctggcaggcgagggagtcgaggcggcgtggctgacgattctgggcgtggtctggtcgaccccccgattttcgcgccttaggcgcccccatcatcagcgcggttaatggcggtcaaatcgccattatggctaatgcgccagcctggccgcgcggcggcaaccgtcaggattccccgtcgggcccacaacctcggcacgggaagacgtgaggcgccacgtcagactgccctcacaaggccgatgtccgacgtggtgccgggggctactgtcggagatatgggcccgggggtatgcaaagtgaggggaagttaccttcccatccagccacatggctctacagcctggccctacccccgcacctcgtgagtcgcaggtcgcagaagcggctggggggcctcggggtgccacgtcatgcccctcgagctctcgcgttgccttgccccgaggccctcccccagctgctatgtggcggggggagcgaggggaggaagcccaggctgaacagccatcaatgcgcggcaccccaactatccctcaccgcgtttaatgcggtaaggacggacgtgcggtgccgcaccactgatccacgtcaatcgggtctgactagtctgtgaccggcctgtcgccggtcacgttcgactgaacgggcggcagtgcccccacgtcgcctctgtatccggcgaagtggaggtaggtatgtcccgtcccatcgaaacgtcattcggagttccctccgtgagaggaggatcgccacaagtcttcacccatttatgagggaatgacagggctgtcccccgtgtcaggcggggggggtgcgttgggtcccgctcaaggacggactgctgcttagcttccgggcgaaggcacaggtcgcagtccggtcaaggtagagtgggtccccctctcgtagaagagtaggtagaggcggtgcatgcggtatccccttgaactatagaaggaggaccttgcccaccgagaaaaggagcgactctcagtaagcctgaactctaggagaagagaagtgggagcgctctccggagtttaggaacccttgtaacactcagccataatctcacacacaggagtagggtatcgcgctccatagcagcccgaacctgtataatcttagtgcccacacgcgttttagtagcattgagggcggattcgcgatctccccacgcgagccttttcccccggccgaactcactaaaggggatctcacgatctcccgctagagaggatcactcctcgacagaagccatcttcaacctatgaatgccaataaaaaatgaattggagataagttaattatacataccactaacatatctgcttcaacaacttcttccaaagtagcatgaaatgcttccactagctgcacaagaaaggttactatattattactgtcaccacagtagttgaaaaaggctttcatgcatcattaaggttcccctggaggcctagaccaaagtggcatgatagtgctgtgattggcagcaacaccacaagggcagggagagatagagtaaggaatttcaggtcactcttgcttagcacttcatgagctaagacctcatgttaaaaagagcattcctaagataattcaatctaagagataagataatagagaaactaggaagtaatgaatatgtgaacttcaaaccacatacttgcaactaacttgcagtgccagctcttttctctcttttactatcaactctgcacagttctaacctagtagcacaatgtaatacaagcctctctgcagcattttcttaaaaaaatgtattaaccaaatctttatagtaaggtgaatgttggggtttagcagaggtcggcataacagatggtttcgctttaaatcgtgccagcagtgctgttggcagagtacaaaactatgcaaaataaactaataacttgtatgcaaaatggtagacgctaaatccacgattgtgtcaaaacaatctgcaaggtcaaaattaaatcaagaaagctacctgcacaggcaagtctgagatgaagccaacagtatcgctaagaagtgcttttctcctgaatagcatttgacaaaaaaaaaagattatatactgaacatgcactaatcacaaatcaaatctactgacatacaatagatgaatgaaaaatctattaaggtaccctgatgggaggatcacactgcgtaagcggggatccactgtagcaaatagcctgcatggaaacagtaaaatgatttggctacacagtgcacatttaaaatagtaagctatacagggaaaagttctcatcatacctgtcatcactgtatagatcagtttcagaaagtgcactcactagagtggattttccctgtaaaagatagcatcaaaggaaggagtttgtagaaagctcagatatatttcgctgtatttctggaagagcatagaaaatggttgtccaatattaagggagagaactgcaatggcagatcaacgtactgcattagtgtagccaacaacagcaacggggtgcaggaa

SEQ ID NO: 69584 - DNA, 10478 bp, Oryza sativa
  unsure (1)..(10478): unsure at all n locations
gccccatcgtcatctacttttctgagatttgtatcaaagttgcgactgtatcatcgccatctacttttgtgcgacctggggataaaaaggagagaaggaagaaatacatattgtacctcaacaggagagagaacatacttacgtacgtacatcagccagagttggaactgctaccacctgttgctatccaaaacagagaatcgttgctccaaatgcaaatgatttcatttttatgatgtcagtaatactaacaattaacagaggaacagactacagagcccacggccggcgccacagggcacatctgaacaagcgtggagcccatgtgctggacgatgcacacagccatttatttttgttcctgaaaaccatatgcacagccattaactgtaaagcacatataaatacccaaggaaacaaacaatgttgttacagatgtcattgtatagcatggacgtgttccactgttggatgaaaaagaagcagcgtaacatattactcggccgcaaaattggagcggcgcgagaagccctttcggcagcagcatgcacgagcacgacaccgagcatcggccaggccggccccagcaagagcaaagttaagctcgcccagccggcaagcaacacggaacgcacgatcccctgctcacgggtcgaattcgaagcagcagcagcagcagcagaaggagaagcttcttaattcgttcgcgtttaacaaccccatccccgtagacgacgacgaggaggagaacgatggcatggcatggcatccctgtcggcgtgcagtaacacctcactctgctgctgtcccgacgttaacctctcccctcactgacgctaagcacactggcagtcgcgtactacacgcggttagagcgagcttccattagcccccgagaaattaacaaaaagcaaaagcagaaggaaaaaaaagaaaaacgtcactcgcatcacatcacagcactagccgctctctctctctctctctctctctctctctctctctctcctcaccagattctatataagcagctcgtccaaccttgggaggcacccagcagcagccagctagctagctactcctactcagcagcagcagcagctcaggtctctccagtgttcttcgagctatacactagctctcacagatttttgctccgactcatcaagcggattgattcgatcggctgttagagagagaaaaaaggagagttggagatggtgagccaagtggtcgccgaggagaagccgcagctgctgtccaagaaggccgggtgcaacagccacggccaggactcgtcctacttcctggggtggcaggagtacgagaaaaacccgttcgaccccgtctccaacccttccggcatcatccagatgggcctcgccgagaaccaggtacgcacacgcgcgtgccacacctgcatgtacacacttgtacatgtgtgtacactgtctctgacgacatggttgctctgccttggctgttgcagctgtcgttcgacctgcttgaggagtggctggagaagaacccccacgcgctcggcctccggcgagagggcggcggcgcctccgtcttccgcgagctcgcgctgttccaggactaccacggcctcccggctttcaaaaatgtaattaattaaatcaactgtactctggttcgcgtacacggtcgtcaaaagttacagttggctaaccccccgagcatatgcgcacgtggattgcacaggcattggcgcggttcatgtcggagcagagagggtacaaggtggtgttcgaccccagcaacatcgtgctcaccgccggcgccacctcggctaacgaggcgctcatgttctgcctcgccgaccacggcgacgccttcctcatccccaccccatactacccagggtacgcactggcactgccgctgctgctacacctttttaccatacgcgacaacgtgcatggtggcgcatggctaacggtggatggatgggtggatgcaggttcgaccgcgacctcaagtggcgcaccggcgcggagatcgtacccgtgcactgcgcgagcgcgaacgggttccgggtgacgcgccccgcgctggacgacgcgtaccgccgcgcgcagaagcgccggctgcgcgtcaagggggtgctgatcaccaacccgtccaacccgctcggcaccgcgtcgccgcgcgccgacctcgagacgatcgtcgacttcgtcgccgccaagggcatccacctcatcagcgacgagatctacgccggcacggcgttcgccgagccgcccgcgggcttcgtcagcgcgctcgaggtcgtggccgggcgcgacggcggcggcgctgacgtgtccgaccgcgtgcacgtcgtgtacagcctgtccaaggacctcggcctcccggggttccgcgtcggcgccatctactccgccaacgccgccgtcgtgtccgcggcgaccaagatgtccagcttcggcctcgtgtcgtcccagacgcagtacctcctcgcggcgctgctcggcgacagggacttcacccggagctacgtcgcggagaacaagcggcggatcaaggagcggcacgaccagctcgtggacgggctcagggagatcggcattgggtgcctgcccagcaacgccggcctcttctgctgggtggacatgagccacctgatgcggagccggtcgttcgccggcgagatggagctctggaagaaggtggtgttcgaggtcggcctcaacatctcccccgggtcgtcgtgccactgccgcgagcccggctggttccgcgtctgcttcgccaacatgtcggccaagaccctcgacgtcgccatgcagcgcctcaggtcgttcgtcgactccgccaccggcggcggcgacaacgccgccctccgccgcgccgccgtccccgtcaggagcgtcagctgcccgctcgccatcaagtgggcgctccgcctcaccccgtccatcgccgaccggaaggccgagagataatcgccaagaacaaaaccacaccatgtccattactattaccagtagtagcacatactagtacattactacgtcacagtacactatactagtagcagcagtagcagattcctttcgtttcttgtaatcttttggcgccatttttttttcctcggatcgaggcgtgcatgcccgatggtctcggatgatcacatatcgatccattccatcagccggcatcggatcgatcccgtatttttcactgggaattttcagttttcccccgacactgaatttctcccagttgttgtaacctatggaaagtattattgctcgtcaataaaagctagtgcccaccacttgtagttcacgactaccactcccacatttgggctcggtcgcatccatccatcgcgtgttttcgccgccgctgtcatataaaagtcaaaaccgttgcagcgaaaccacttgggccaatggcgttttttaacccccatctgctccgtattgcatgcgaccgaggggattgagagaggaggagtatatagcacataaatactcgtagtaataacgcggaggtctccgggcttgacgtaacgtggtagttaatgctaagttgttaatgatgctgttgtgtttgccgtccgcggcgggcggcggcgtgcccacatgatggggatggatggcgagcgaattgacggcagtgatgaccactagtcgttgatcaaggaaatcgccgcggcgagtgtaggcgaattgactttggagttgggaggccgggacggccagttgcgccctgcacggtctggttgggagctcgatgactcgtcggctcgcggcgggatcacgtgccgggcgatctttagctcgttgatttagggcatttttatattgtagccaaaataaactttatcaattttagtattgctaaactttttacaagatgataatattgctaaaattttgacatgatttattatatatttactaaatttggcaacaaactaaacgtagatattttttagataattttaccaaaaaatgctatggtcgaaaatagcatcaaagtgaacaggtcattggatttcggctgttttctctttcatctaggctgtgtttagtttctgcaaaaagttagaagtttagagaaaagttggtagtttggaaaaaaaattagaagtttatttgtgtagtaaagttttgatgtgatggaaagttgtaagttaagggtagttagaggttaactaaacatggccctagggtggctggaattttggagtagtccccattggttaggagatataaaatctagcctttaatgctccgagaaatgcttccgaatgatagcggcacacacagttgattttgtaaggctactgcaatgtcaaacggagactttttggttaatgtgctcggtagtgatactccgtagtacattatttggttaataagtgtatgtgatgatgatattgaaagctgatctgcgtgagctgatgtagaacgcagcggagcacttgaagcaagtggcagagagtnnttttttttttttttttttttttagcaaagggtttcctaaactgtgatcgcggttaccgcggggtacgataaaagaaaaacctcagtaatctccttaaatttaaataaatttaaaaaatattttaaaattttatatggtttcgtacgatttattacggttactacgcgataaccacgcttaccgccaggacatgaaaaccccgggcctggtgatttgggaagccatgcagtggtactgctgctacttaccagctctggaagcctgtaacttgggactgtacattgtcattcggggttagcttactttgtgttcacactatcttggtaaaagaaaaaaaaagctgttcgtttggtatcagtgttcaggtgtgctggagattattaatcggactgtttagtgtcatggtttgttttatcgctatgttcttttgtggcatcaatatatgatgccagggcttatatatcaattgttaatttgtcccatagaactgtactaccagagtgtgtttagttcacgctaaaactgaaagtttggttgaaatcggaacgatgtgacgaaaaagttggaagtttgtgtgtgtaaaaagagcaattttacggtctttgaggaggtaccatgaggtaccattttttctattgtaaatttggtacctcttggtacctatgtgctatgaggtaccaaattttacactaaaattttggtacctcatggtacttcctcaaggaccgtagaattgctcgtgtaaaaaagttttgatgtgatggaaaagttggaaatttgaagaaaaagtttggaactaaactcgaccctagtcatcttgatgtattcatcacaatcttagccaggggctgattcgacgtggatcccccctacacccacaagattcatggatacccccgtgagcacctctttgattttttttcaccataaataataaactaaaggtccctaaatgattggaggttgaagaaactctataattgagcctctctaattttttttcctagatccacccctaatcttagcatatatgtgtacgtttcatttcaatacctagttcgcgaaatctttcgaaaatgttgactaataggacgaggataaagagaaaatcacccgacatacccatgtcaaccaccgatatgactcattcacttgataaggtgtacacgactcttccatcttattcaacgttttccattcgctcaaagtctagacagtaaggaagaattccacttatccaatgtttgacgcagtagctgaaaatttttcaaagcaaagctactcgtttctactttgggatacgacaactagtcaaaaatgtttgacatgaataaccacctgatagattgcgcgtttgcgcactacaactggaaagtaggaaaaccgttcttctttcaatttagcccttatttcatagatcttgtttagacaaaaatgagactgacaatctccttcgacatgagaaaaaaacgaagttaaattactcctaacccttccttagaatttagagcatgtactatggtgtccaataacggactctctttgttgtcatgcaagtaaattttatgacctggaagaataagagggaagaaaagagaaacatcgttgctacgcatgacaacagctcagaatcgattcttagtatttattaacggaaagtttgttgcatgaggttggagaaaaggaaagaagtataataaaaaaatatttagtgcaataatgatttagaaattttattgtttctaccattgtaaaaggatagtctctagtgatattaattaatatagatagctcatattagattctacctttatatatgtccttaggtatcaatccaaacaagatccatacatagatctaaaagcattctcatctccgacggaaaagacgaaacatgaacataaacgtggaaacactcgtaataattaagcaaactagattatcatccagagaccaactatcacattcccctcatttctttcaggggaacagaggtaaaaaaaaataaaaaaggagcaagacaccctgttgctacagtatttttttcaggtggtacaggaaaatcccttgggtagtgtacgtagatgaagccaagggggtttgccaccaacagccgcgacacatgaggggcagatggacaaacaaggagagactggaacgggacaattcgccgttttcgggagatgggagacgcagcagctaaccgcaccggcatgcaaacgaggagagacctggagatcagagtctcggagaggcaggtccgagcacggcacatgggggctcacccccggccgtaggccggcggggacgagatcgacgaccgaacgaatccacaccatttggatggaaaccggcctgcccccgggcatggcgtggacgcgggtgtctggacccagaagggaaattccttgactcgcccgggacacctctgcactgtccatgcatgtgatcgatcgagcaagctgcgattttattggttggttttgctggataaccccgatctcctgtcctcaacattttggtagtttgactgagcatgatcacactttgaccgttattacgttatnccaaancgaatagctatacttttcggttcaaaaaaagacactcacctcngncacaatatcacctctactaggacaataaatatgtactacctttttccagattcgttgctttaggagggatcacatccacttctagattgagttttttttgatggagtgagtagatattacgctttagcgaagtaattgctattgaattctaatgatataactattacattgcatgtttagagttctaaaattgttgttatgtagaaatatactcatctcgcttatgaagaaagaatgtgctagtgtaacaacggcataggtctgtctagccaattgcgttgtgtaataaaaactatttttcttctaatatattaatgtgtaaattttttgcgtgttcgaaaaaaaaaagtgtaactgtggatcgatgatcgatcactcccattactcatcttatcttctagaaccatatcatgtgtctccactgtgtcaattattttcatgtttcctccacgtacctcgatgtgttgtactaacatttcacggggtcctctgatcgctaccaggagtctagctattttgagttatgaaggtgagctaggtggctgaccaatgaaaacagagggagtatttgcctttacttgtagtggaaatattagggtataaatgattggagtgaatgaatatggctttgcacaaagagggacatctagataaggtgatatatacctttccttgtacgtgtagggttgccaatatgctggatgctgcccatataatgtctgcatgtttgtatgtgttgtgatatgattcgacaatgttactgtagtcagtaccatatatcttgccttggcactatgggggtaaaagtgattaagctgacacgcaacatcggtattcacggttgaagtgtgatctttatcatctgtttattagattatcaggtacaactaaaatttaaatttaaaacttaatttctagggttttatcgtggaatgtttttctgccttattttctaaaccacaaattaacatgcataaaacttttaccagtaaaatgttaaggtcacattgtttaccctttagcttacaagccgcagctaaaatttagattttaaaaccatattttagatttgattttagcctttttttttcctttacgtggtttatttttcagcatttgttctcaaattgataagagcgtgcatgtaagttttatttgtaaattatttctttgttgttaataagctattgtggtatgtaaccagtataaacaaaatgatgattgtgccatatcgcttcattcaatatatctacgggttattagtcatagccgactcataggttaaccaatcagagaatattgatcagcagcatgagtacttctacaccctccgaaaaaaataattcttaattctagatatgaatctggatatatatgtgtctagatttatagataggattggtttttttacatgaccaatagacttcgtgccaaaaatactttacatatttctgtattttctatgccgtgccgctgcctagtgcctatggcctaccatcacacaatatgcactaacctaaccaattgttaagtaataagaggcgtggctagtctaattaccatccaagcatgtcggctatattattgatactgacgatatatagggtgtacggtcgtcctctgtttgcaccttttcgcacattgttttttttcgaccgattttgcccttttcgatgtactatatcggcactgatgatatagtgatatgggcggccactaaccacgcaaactttccaagtgcagccatttttttcgaagcttcccaggcccagcttaattaattatctacgactagatgctaatatctacttaaaaaagttttgacaagacttgcaacgaggagcacggatggtcttccacgtagtctacgcgcttttctctggaaatgctacatccatattttaatatataacgttgttgacttttttacaacgtttgatcatttattttattaaaaaattatataattatcatttattttattgtgacttgatttatcatcaaatgttctttaagtttgatatgaatatttttatatttacacacaaaatttaaataaaacgaacgattaaacgttagtaaaaaagataacaatatcatatattaaaatataaagggagttctatataggaccacccactttataaacctaaacctgagtgatacgtagatacttgtaacttgctcctgctgtttgttttctattccgctagatgcctagatcccatttccttgtaaccggcaacgattgcggtttggtatcttacgttgtgaacaaaactcaatttcttctactacctccgttctaaaataaatataactataaatatctatattatatctaacgtttgaccgtccgttttatttaaaaaatttattaaaaagatttaaaaaattagtcacacataaagtactatttatgttttatcatttaataacaataaaaatattaatcataaaaacattaaataaaatgaacggttatacgttagacataaacaatgcaaactacacttactttgggatagatggagtaatataatatactgatgtgcaatcattttgcaagttcgtgaaaaaaaatcgatacttgctcctctcaaattgatagtacttcgcattttaaataaaattgttaacaaaatttagaaaatgtgatgataaataatctttaaaatatctatcttaaaaatatgaagaccatgcatatctacattttaatcttaaaatatacttcaataaattcatttgttgattgatatttatatatattataatagaatatagcgatcacaatttttttttaaagtgaagtattatctacttagagagagcatgtactccctccgtcccataatataagggaatttgagtttttgtttgcaatgtttgaccactcgtcttattcaaaaaattttgaaattattatttattttatttgtgacttactttattatctacagtactttaagcacaactttttgttttttatatttgcaaaaaaagtttgaataagacgagtggtcaaacgttgcaagcaaaaactcaaaatcctttgtatcgtggggcggagagagtagttagtaacttactatattttaatgcttcaatcattttgcgattggtgtggctctagctagacttctagtcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69585 - DNA, 1735 bp, Oryza sativa
cctgcagcccatagttttgcaggaaaatctataggaagctggaaacaacagtgcaagcttggctttctgtcgattgttgctctacgtggtaagcaacgttcatggtgtaatttatgaatgattagtactttctctgctacatattttgtcaaaatatatgtcattagattggtgtctggtgaatctattaggttgtgtgatcagtgtagataaatttgaagtgtcgactcttttctgaagtgaacagtccatgttgcagccttcagtgatccaaacttctgaatctgtgagtttcagctctcttttacttctgagcatgatgaagggtagtttggatgcttaacaagtgattgtcttgtaccaaatcatgtaatttttatgtctttggttttcaaccacctctccaacatcttaaaaaatgttggttagaaatcagatgatcttcaaaatcaacctttctaaagtaacttgggagtttagaaaaagagtaaagtgcacaggcggtccttaaacttgtagaggtgtgtcatctaagtccctaaactctcaaaatgtagatccaactcccagaacttgtcaaagtgtgccatataggtcccaaatcgcaacaactcctccaaaatcctacgtggcgctgatgtggcgtgccacacgaacgtgacgtggcatttaaaaattttccttttccttttttttcttttcttcttctctttttttttcttttattctcttctcttttctctgtgacctgagcaacccgtgtagcggtggcctatatctgcagtgagagcaagaaaaggagaagaaaggaaaaaaaagagaataaaaaagggaaatgaaaattttttaagtgggtctcatttgtcattcaatattatgccatgtcatgtctgtgtgtcattgccacatcagtgccatgtaagatcctggaggagctgtgacgatttgggacctacatgacacactttgacaagttctaggacctggatttgtattttgaggacctagataacacatccctacaagtttaaggaccggccgtgtattttactcttttaaaaacaattgaatcaatgttcctatctttggaggctagaaaaggagaaaacatgattattgaccctgtaaactatggtctcccactactgttgtatgtggttgattttatttttcaaagaatccttacgctttgattgctcaagtgaaactgatcatgcaatgggttttaaatcaatatactttgagcaacaagtataattagttgtttgattctcaacatgattctatttttctgtctatcaccattgttttatgaaatatcaccgtagcgttagcacgttcatattactagtatagtaagtcaattagtaattagtaggcatatactctctgtttcatattataagttgttttgactaatcaaactttatttaatcaagttagcatagcattttaaatacaaaacaaatatgttatcaaaaaacttggttaagtttggctacggaaaaagtcaaaacgaattaacaaaatatacccagatcattcctaaccgttggatcctctcatctaacgacctacattgtgagttggattagcagatggattagtagtaggattagtgaaaccaatggacaacctccttgctttgagcaccccacgcctccacttcgtcgccgccttgaaccacccctcttccttcccatgtggctcatcgccactgccatccctcatccaa

SEQ ID NO: 69586 - DNA, 1601 bp, Oryza sativa
gcaatagtggcggtttcctgcggacaaagggggagagatggtagcaacaacggttggcagcacacgcttgagtcgcctgccagttgttgtaagtaactgatttaccagcgcttcgaaattttttcaggtcttcacatcccttgccagctcctgcgcggttgctcccaccgtcggctaaaaaaaatgagttcaatgctcttgctttgcttggtaggcacgatttgctgctccgctgcagcaccaaaaaccactaatgcgttcctcctcttccttgttctctttgtatccttgttgttgttgttgctgctgctattatgttactgcctccgcattgctctttttgatttgttgttgatttgcttctgctctgtgctgacctcatgatgtatgtgatgccgtgtactgctgccatggctagagaatagaaggatacaaagagaacaaggaagaggaggaacgcattagaggtttttggtgctcaagaactgctcgatgaaatgtttcttgaggtactactaaagtttgaatacatattgaattatctttttagtacttttacatgcggaaaccttcttccttgtttttgttattatattttaatggaaagtaatttatatttaacaaatatttcaatggctcatccatgtcaatcaactaaatcaataagaacatgcttagtttattcccattagggggttgtataaaaaatacaaaacaaaatagatgtttggtgattgtatttacttgatctggcttttggtgtgctcctaagcaagtctgtcaactttttttgcctgtggacatattgtaggggctcatccaagtatttgtctcttctatcgattggcatgtagtgatttagtgccttcctctggattgtgcacacaagaactgttggccaggttagtcaaggttgtttagtgttgttaagattatcatgaatgcatactcatccttattataaacacccctctccccattatctctctctccgcatgagggatgagctgctatatagttacaattgctttttatcacaatctcacatgtttgtttatggttttttttattacaccatgtttcatttattagcttgatcactatttctccttcttatatactttagttcagtgaaagtattttcagggaatacggcaaagaattatgcatcattgtattaagagaaattaagttcaagaaagaaaataaaaggtgttggcctaattctcgttggttcaggtgtgaccaaatcgactaccaaaaaaactacaaataagctagggcagaaaacctgcatccatcggcatcaggccaaaaagaggagcacacaaaaacttcagtccctccactccaaacttctcttggctcatctctatccgaatcttgatatgaatacttcatttgccacctttttttccatttgtattcaccatctcagttcatgttctatccttttagcctttttcctatcatttgcattctccaacgcatttgtcaatactagaacccttttcattataagaattccaaatttattcaactacatgttgtaaatcctctcaagaactagttgatttcaaagttaaacgggctgcaggaat

SEQ ID NO: 69587 - DNA, 965 bp, Oryza sativa
ttcctgcagccttgctggagttgctcttacggagatgtctcggtggatatgtggtttgaggtgctttgggttcctgcagttgctcctccaatcagcacaccagttcttttgtgtcgtgagacacatatccactaccctgcacatcatgatggttatgatcaatatgatatgttcactggctcaaataatctccttatactttataatctcatgattaatatgcatagagcatgacgataatcaataaattctactctctcagtttcaaagtacaagtattaatagtttgtttagaaaaaattgagaataaaatgaaatactttcaatgtcttttcctcagatccctccccaatcaatgatggaccaaaataagccgtgcaatgaaagatccctccccaatgatggaccaaaataagctgggcaatgaatggagtagtaaagcactactaacattttttctactttcctcgttatgtagtacgagcaaatatatttttaaacaaacagtggatgatggtacttggctttggaatagtgtcatggaaattatttataaaactgactatattttggaaatggatagagttaattaatgttttgtttatatgggcctcaatgctggccatgcaaatgaggtcttacaactcacttcccctcaaacgccccctaatttgattaagttatatagagtaaaagttatatctatgttcatgtaggtgctcatgtgttacacgtgaggtagggtgaattgcagcttgagcgctaccctgcttggtagacagcatgatctttgcatcagcgtggttgagtgcacacggttcctagttggatctgtgctagcggtgtttgttggagttcttagcgttgtcaaggcactagcacgttatggatcctcggatcctgatttcctcgtgccaagaagtatgatctataaaactatacgcagtattatatatacacatatt

SEQ ID NO: 69588 - DNA, 5493 bp, Oryza sativa
tcaagttaatctagagagtttgttgttcagtgtttttgtttactaaaataattagttaccatgactggtatgcttaccgaccttacggatatgtcttgactaagtttataggcaaatatagtaatatttataatactaaattagtttcatcacatcaataattgaatatattttcataataaatttgtcttgggttgaaaatgttactactttcctcatcattgtagtacaacaaatacatttttaaacaacagtggatgagtgtacttggctttggaatagtgtcagaaattatttataaaactaactatatcttggaaatggatagagttaattaatgttttatttatatgggccttaatgcttgccatgtaaatgaggtctttcaactcacttccctctcaaacgccccctaatttgattaacttatatttatgttcatgcaggtactcatgtgctgcacgtgaggtagggctaattgcagccttgggtactgccctacttgctagacaacacgatcgtagcattgtcaaggcactaggcatgctatggatcttcgatgccgatttcctcgtgccgagaagtaggaggatctataaaactacacgtatttttcgtcttgaggattaggatgatatatgtactctacatctgattgtgttagcactatgtacacatctaccgtctcgtgctgaggaatgcatttcatattaagtttgatttccttacgctgcaaatgataatgcattttttatatgggacaatttgaaccatgccacacaaattttgcaaaatttgtgatatgccaccctgacccacatgtcattgactcgtgggtcctacatgtcattgagatgcgggtggcatatctcaaatttagcatggttccaacaaaccctttttatatttattagtgtaagtttattttcaggtgtgatatctgttaattcttattgtggatgattcgtttttgtcatcctgttatctattttctttcaagtgatatatgttagctcaaagtgttgtaattaaccaaaataaatggtaaattgattatctcatcctaaaattttaaatgtttgatcaatttattcaaatattgatgtttatttctataggtttcccctccactttagcttaagctccattggtgacgacgagcaacccacaaccatggagatcaactatttctataaggtaccctttgttttatgagcgtaggggggcatgtggggtattgcctgtcgtggacttcgctcttaggcactgttgcaacgacggtgcgggagagagtgagataaaggaggcgctactagctactgcggatggtcgcgtagtgctcatctaccaagaatcgtgtataggtggtatgcgtttaagttgacttatatatgacaaaatagatattagagaaaataagtatggtggttcaaattggcgatgacgagcaacccaaaaccatggagatcaagagggtgaagattgtagttcacgtggcgagcatcacatcgatgatccttgcctttaggttaatgtttatcatctatgtcccgatgtcttatgtcaagcctctgtcctacaggttaatgtttgttggagagtttgttcccacttttttatggttttattccgagttaatctggagagtttgttcaatgttgttgtttactaaaataattagttaccatgactgatatgcttatcgaacttacgtagatatgtctgggtggatacgtggtctgaggtgttttggggttgctggagttgctcctccaagaagcacactagttcttttatggcgtgggacatatatccactacgctgctcaccatcatgatcataatgatatgttcactggctcaaataatcttcttgaactttgtactctcctcagtgtcccatcgatatattgcaatcttcttgaactttgtactctcctcagtgtcccatcggtatattgcacaaagagacattatcagtagcaaatcgttgaactgagacaaactcagtagcatatagtagattctctcttcttttttacactaggtaggtgttcgtgcgttgccactgggagaaattgatgtgttccagcacacgaaaaacgaaaattggtaaaataaaaaacatccacattaaatatatattatgccaacatcattatttttgttgtggtttagaataattgtagtcatttggatcaaactccctctgtcccaaaaaatgacaaaccctgggtttccgtgtccaacgtttgactgtctgtcttatatgaatttttttataattagtattttcattgttgttagatgataaaacatgattaatactttatgcgtgacttgtctttttaatttttttcatatttttttcaaataagacggacggtcaaatgttggacacggaaacctagagtttgtctttttttttttacggagggagtatatttgaatggacaatatcattcacactttagaaataattatttatcataattatacctaactctagaagataactaaggtatcgaaataagactagaaaaggcttatacggaataatctttttgtacgcataaaggcaatagagaagcttacatttacataggatcattcacgaatgggcctaaagagtgtctaataagaatataacgcacaggacgcttgcaaaaaaaaggaggaacaaacatctatctatagatgggcttgtgctgacatcatctatacgtgctttgctccagtgcaagtcctaaaatatcaggtttgtacgtgtcagtcagtttgatactataactgacaagatagataaattgatgataaaagaaccgatcagccaataagccgatttgatatggtcttgaacaattggctatatgtccgaggtaaattctaacgctcagataaataatgatataaagacaatagaagaacttgaacaatcaatccaatcgaccgatgataatataatagagtagatatccaatgatatgtgccgaagttgtatttatcgagagatattaatacatgggtagatactagtctgtttgaaattcctggctcttgaggcgccgaagtgacctcttccaccgcgccgccgcctccggtaacgacgatggccgagacggtggacttcgcgagcggcgacgcggcggagtggcgagcggcgctggcggcgtacgaccgccggctcgcggccctgggcaagcccgacctcgtcgaggtcgactccttctaccgccgcgacctccccgatctcctgcgccgccgcgacccggagcccttcctcgccaagcccgagctggtgcgcctcctccaatggaagctctcccgcggcaagtggaggtcgtctcatcccgctcttagattttctttcctgttcctctttagagcacttgaacttctggttcccaggggcgtgtgatgttgtagtagtatttctcgctcaaatctccctagaaatcgtgccgaaatgtgtggatcaattggatgatgctagtatcttaagggtgcttggactgatttgatccattgatttagggactcgttttcttggcaaatcaatcattaccctagttggttagttgatgatactcctacactaccctgttattatcaaactcgttgggggaaaaaataatcatattgttgctctgttcttttgtgcaggccgagactgatggatttcgtcaagggcttggaggatgcagtggtagaatcagcatcgtgcaaggcgttcgcagcgctgcctgacctccgcaaggccatcaccgagctcaccgtgctgaagggcgttggccctgccacggcatccgctgttctcgctgcctacgcgcctgatgttgcaccgttcatgtctgatgaggtgagtttgtgaattttgttttggcagttctgcatttccaggtgagatgaatgcatctttgatgttgtaaacatggatggactgtgtttaggctatggtggcagccttaggcaatgcaaaggagtacactctgaagcagtatcttgcttttgctgaaaagttgcaaactaaatcgaaggtattgcttctgcatttgtgatgtgtgataaactgttgttaagatagcatttgtttttcctgattgtgctgatcgaagtgtctgtataataagccttcggtttgctaggcagctgcaagtctgaacctagttaatgctttaggattgttttgcggtgactatcacttgagttcagacaaaggggaaaaaaatacggtgtattcccttgtgtggagatttctagttgatacacttcaaatatgtggttgatttaatgcagataaactgaaagggacttcaaaaggtagctggttgtgtggagtcattttagaagaattgatcttagctgacatttgaaattgaaatagaacataccaccacatattttttgttatagtactgttcaagaactagtgcagaaagataacacctttttcttgtttgctgatgcttctctaaatcataacgtccaataggctcaaggatgccaggctcataaatttacagagtatgcattacaaaaatcgtatgccaaattttcagctgcttgcctttttattccagacagcagctgcaacaatagggtaatatactgataagctgattagtacttgaacgttatgcttttatatttgcaaaatgcaagcatgtaacgtccgcattgctagaataacaccgagtaaactgcaaattccatatcaaaattatagattgttgaacatttggactgttagctgaagtctgaagatgaacacatgcggtgcttgattgacatttatttcatattttttgtttctctggtaggaattgagctcaggagaagaagttttcactacttctgatgttgagagagcgctgtggagctcagcagttgcatccaagtctcttaaggcgccaccaggaaatgaccttgagaacaagtcaaagactcatggcaagagaaaacgatgactcttgctgccaatgttctagttgagctaggagttactgatggtaggtcttagaacttagattgttcattgtatgaagttaagcaatgcttctgcatctgcaaaaagaatgtggactgcgtgctcccgatgagcaggttaaaccctttggaaatgtcttccgctgtgagtctgtacatcagtacatggcactgaatgagctgggggtgatgggtgtgtttttctccacaaaatggcatggataccagatgttgccatgcgtgtgttgttctttgttagataattgcatctgatcctttcttctgtgttgccattcgatttaacagttcatgctgtgcaggtgaaattgcattgtgcgcttcgtatcgctgaaaataaagataagattgagcattcgttcatttttcacctgagattattactgagcgttgcatgtagaggatcgaaggatcccattaaagagtgggttttaacaatatgaggatcactgcaacaaatcaggtacattttccaaggggctgcaggaat

SEQ ID NO: 69589 - DNA, 6508 bp, Oryza sativa
cagctgaacaattatctgttcggttgtgtaatagatcactcatgaaacttcagtcccatagtagcagatcaggaacgtggagtgtcatagcactagcagtatggaaataggcacatcatatggtgacagaggcagcttttacatgtaaatatgttatggatgcaaaagggaaacattacaggcaaagaacaaactgcagatataagtatgttctactccttccgttttataatgtaagtcattctagcatttcccacgttcatattgatgttaatgaatctagatatatatctatctagattcattaacatcaatatgaatgtgggaaatgctagaatgtcttacattatgaaacggagagagtaattgtctatgttaattgctacacctcaatggctagaattgatcagtaaacagttattcaatatgcaagaatgaatagatcacacttgcttcacaattacacattcatttcagatctaaacagtaactgtcaactacatcgtaattgttcccatcatatgttggagactaataatgggtaatggttgcactggagattagccagatatgcactcggcattctggtttttgctgggagaggacataaatcagacttatgaagtgaagataaaatatatgacaagagcacctgatgaagttatttggtatgcaagaactttctcaataaacatgatcctacaaaattgttgcgagaaaactttaacataagcaaatgttgaggcaatccagattgatagtcagcaataaggcattaggcatggcatagtaaatttatgcagatacggccccaataccaactgcattcaagtacagttcctatacatatactgtatctagtaattaaaatgaattatcaattactgggcaatgcagaaaagtcattgctagacctgaaagattgagctattcgaacataatagaacattctgacagcagtaggaaatttcataaagagaactgaacttgctgaagagaagtaacagaaggacaaagatttctcttgagagatgaacataccatgaatcacgctaatcctcaagcgttgaaatgtactcatctatacgccgatgcctctcccgcagggctgaaagcgcctcttcagcagcctcattgatcatcctagggaggtacacattcatcctctgaaaccactccctcagtgtcatggtttccaagctgctgctcccagaactctccccctccacttccacagccgctccctctcctctaccgccgtctttctcctcaaccgcgttgtccgaagcagcatgagcattactacttgcagtagccttcccctttggagctcttcgtgcccgtcctctccgcgccactggcacctcctcctcctctgatgccttgtcattctgttcaacttctccatccatggcttccaccttatcatcttcctcctcaccgtcagtcaccgccattgccctcggttgatcctttatctgctcttctgccacagcagtagccccctcttgctgttccccatcatcgtcatcgtcctcaggaacggccatcctacacttccttgcattagaccttgtagcccttccccgtccctttccggccatctcgctctccctctcatccaggcttgtgtccactgccttgcctctcctagcagcagctctcgtcgaccttgccctcggcggcggtggcgcaacggctgcctccggcgccgccttcctcgacctgccgcggcgcgtcaccaccgggacctcctcctcctccttctcctcttgttcctcatccttccccttctcttgctcctcctcctcatccggtttagggggctctgcggccttcttccgcccacagcggcgcgtcaccaccgccgcgaccacctcctcctcgccctcctcgtgctcctccgctttggggggttgcgcggccttcttccgagcaccgcggcgagtcaccactggagcctcctccggctctggctcttccttctccgcaatgggcggctcaaccgccaccgccgccgctgcagcgttcttccgtccgccacggcgggtgaccgcagggggtttctcctgctcccccaccactgcggcggattggcgcgaggagcgcctagggccagggttgggatccgaatcgggcgcgatggagaccacgagcatgctggactccccgatcttgatgacatcgccgtcggagagcggggaggggacggtgggcacgaggggggagccgttgaggagggtgccgttggaggatcccacgtcggagacggcccaccgcgaggccggcggcgggaggaactcgatggagaggtggcgctgcgacgccccggcgtcgcgcacggcgatgtcgttgccggtggcgacgcggccgacgcggagcacggcgcccgcccgccactgccgggtctccccgccgcggcggcccttcttcacctgcagcgtcagcaccggcggcggagcgtcggccatcgccgcaccgccctgcagccgggagtggggaatcgcggagaggagagggatgcgaaaaggatttcaaatttttcggggggaatgcgaaattgccgaggagtggatatgggcacacttccacctatcgtagcagacccggttcggtcgatcggttggaccaaaaaagatcggaccctactattagaccgggccaatagaccgttgagcgacggggagaggagcccagcagccggtgctcgttagagcaagataataatacatccagctgcttagttatagtctatctatcagctcactcatatagtggttaactattcactataaatatatgatccacatgtctgtcttacagattttcttggttcctatgtctaagccggctgtaaactttgtcgaaacatgaattcggcaataataaaacggggtagcgcacgagacctaaaagtggatggatgcagagacaaaggatttagacaggttcaggccctctcaatgagaggtaataccctactcctgtttggggatttgaatccgccgggtgtagtatagatctgacgatcaagttgtctcatgccccctagagggcctcctgcccaccttatataggatgggggcaggattacaagatagaaaccttaaccaacacggtatcggtttcctaaatctactttacaatcttatcaaaccaggactttaggccgttccataatatacagggaaacgtaatacccaagtcataatctgttacatatttcatatatataagttatcccctataactagtcggataaccatgccgtgtgggtatggggtacccataatctccacagtagcccctgagaccttcacagtcgaaaagataatcttctctcgaactagattactccaaaaccgagtacttcaatcatctttgccatggtctcccgagtatttttaccaaatctgaagactgtggagggctgaaaaataaagtcaggtgcatcgactagatgcaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaagaagcttgtatgttgtgaataaagaaattttcaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagccagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacacatgtaacatgctcccgggtgatatagaccatgtgatctgagtgattatcccttatgggatactccaaaatagatataacaattgaatcccgactggcgcaagtattcagttgataacccttacggggaataataaatagtccagtctttgagcatataaaatagacccatgatcatgaattcatgttgcatatatccggagcaagtccaaattgaagatataatacttgtatttgagctagtaagcccctgagcacgtagtcacaattgttcattgatggtagctgacgcagttggcatagagacaagacgaccaatatagagataatattgcccaacagaggtggcaaaaatattggtggtagtgaagatagtgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacgaggcagatcaaaggcgatgacgaaatccaccaatcatgaagatgaggaaaatagtcggcgacgacaaacgtaaccgacagtaatgatgataagcatcaacagagatgtacgacatgagaagaatgttgcctatcaaaacaagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttggcaaagtcttagtcatccattagcaacggcggaatgtcagagctgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcatcttgacataaagcttgtcaaattttgagccatgtatttgtgtagcccccgactctttgattagttgggaaacaactgaacatagagtcgagaattatagcttcttgttgtcgagtagtcatcacttgattgaagatatgtgttgaagatgtccaagtagaaatcctgaatattggagagccacttgttgtagtaaaataacatggcattgcatgccgagatgtcgaggttcacaaagacgtcgtgggtggtgaagtagtaaaacttgcgaagtagcaacaatagagtttgccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcaccagtcggcggcggcataatcagtcggcgacggaagatgatgatgtccatcagtagtggtagctgtataaaccagacgtagaggcgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaataacggcagcataataggccagccgtgcaggcggaaacaccagtcggcggcggtcgaggcggccggtcggtgaagacgtagacgcccaacaacggcggcataaaggccagccgtgcaggcggaaacaccagtcggcagcggacgaggcggccggtcggtgaagacgtagacgcccaacaacggcagcataaaggccagccgtgcaggcggaaacaccagtcggcagcggacgaggcggccggtcggtgaagacgtagacgcccaacaacggcagcataaaggccagccgtgcaggcggaaacaccagtcggcggcggtcgaggcggccggtcggtgaagacgtagacacccaacaacggcggcataaaggccagccgtgcaggcggaaacaccagtc

SEQ ID NO: 69590 - DNA, 1750 bp, Oryza sativa
cggccggtcggtgaagacgtagacgcccaacaacggcagcataaaggccagccgtgcaggcggaaacaccagtcggcagcggacgaggcggccggtcggtgaagacgtagacgcccaacaacggcagcataaaggccagccgtgcaggcggaaacaccagtcggcggcggtcgaggcggccggtcggtgaagacgtagacacccaacaacggcggcataaaggccagccgtgcaggcggaaacaccagtcggcagcggacgaggcggccggtcggtgaagacgtagacgcccaacaacggcagcataataggccagccgtgcaggcggaaacaccagtcggcggcggtcgaggcgagccggtggtgacgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaattttctactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttataatattccccttggtgatggcagaagtggccaatgtgggaacaaagtcgtccatcaataacaatgaagacaccagtcggcggcgacgaaggcggtcgacggtgaaagcgaagacgtccaacaacggcggcataataggccagccgtgtaggcggaggcaccactcggcggcgacggaggcaggccggcggtgaggacgtagacgtccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccaatcggcggtgacggaggcaggccggcggtgaagtcgtagacgcccaacagcggcggcataataggccagccgtgtaggcggaggcaccactcggcggcgacggaggcaggccggcggtgaagtcgtaaacgcccaaca

SEQ ID NO: 69591 - DNA, 1067 bp, Oryza sativa
  unsure (1)..(1067): unsure at all n locations
cccatgaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggtaggccggcggtgtagatgacgatgcccatcaacggtggtgtgaccaaccgaccgtataggcgaggacaccagtcggcggcgacggaggcaggccggcgccacannnnnnnnnnnnnnnngcaacggcagcggcgcacaccaaccgtggaggcgatgaaaccaatcggcagcgacgaaggcggccggcggtacatgtataaaataatagatcaaataataattagtgatctgtgaattaattctaatttatataagaaaatttagaacgataaacctggtttgtgatccaactttgattcgaggcctgtcaatggatgaaccgtagcatgcagccgtgtcatgcagccgtgtagacatgtaatcgtcggtagcacatgcacggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccaacggtgatcttcgcatgattttggcggcggctgcttgctgattgcttcaaatcatgccctggtgacgaaaccgacggaccaacagatatggcagcattgtagcgacggatttgatctcactgacggaggtaaaattgacggtaacaagctggttgtagatcgattcgatcggtgataatctcctggttgattgaccagatccagatagaatttttggcgacgaagaccctgcccttttgttgagaggatcacggccaaagacaagagtagcaccgatgatgccggcacaaagttccatcgcacttctcgacggaaaactcgacgcagcccctacctggcgcgccaactgtcgaaacatgaattcggcaat

SEQ ID NO: 69592 - DNA, 1041 bp, Oryza sativa
agcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggtggaggcaccaatcggcggcgacggaggcaggccggcggtgaagatgacgatgcccatcaacggtggtgtgaccaaccgaccgtataggcggggacaccagtcggcggcgacggaggcaggccggcggtgaagtcgtagacgcccaacagcggcggcataataggctagccgtgtaggcagaaacaccagtcggcggcggcgaaggccagccggtcggcgaagacgtggacgcccatgaacggtggtatgaccaaccaaccgtataggcgaggacaccagtcggcggcgacggaggcaggccggtggtgaagtcgtagacgcccaacagcggcggcataataggccagccgtgcaggcggaaacaccagtcggcgaaggccagccggtcggtgaagacgtggacgcccatgaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggtaggccggcggtgtagatgacgatgcccatcaacggtggtgtgaccaaccgaccgtataggcgaggacaccagtcggcggcgacggaggcaggccgg

SEQ ID NO: 69593 - DNA, 19988 bp, Oryza sativa
  unsure (1)..(19988): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagagtattggaacacttaaaacatatacaagaaggtcaaggaaaaactacctcagtagaggggaagtaataaccagctcaatcttttgtgcaagtccactttttttcacgtgctcacgcaggcagtcaacctacaaatgtacacaaacaaactaataatggaacttgcaattatttttttttgcgctgttttcctgcaggtaggggctaggagatatatatacactaacataacattttgcatctgatatgcctggagtaccagacatttctactttgtataagaacatgaataccattcatgactaaaaatataaccttccatgcttcatccatccacatggaagtttcacacaaaatcagtaaacgcaatacagtgtttctttgcataagccagtttatgaatgaaaagatgatctcgtcacacaaagtcagatttttcagggatgtaaaacgaatatagcaggccttactttatgatctcaaactaaaagtataaaaaaaatctttctgttaaagattttttgcatcatactacttctgttcatttttacttaataagacattttgcatcatactacttctgttcattttttttgttttataactaggtcatcgatatggtccacaatgcatattttatgttatcttcaattttttataaccatatgaaagtgtctttcatgataaatgtactaatgtcattttcaaatatcagaccatcatagttttacaaatattagtgatgtgaaaatggagagtgtaagcgtcttcagaattctatttatttatttatttatcatggatgaggatgagttaataccgaaatcacaccaagtgagtgtggattccaatattcattttgtgcaacaaatttactttggtttgattgaacaagtgaacaatagaatatcagaaagaaggaaaggtcactgtagggtggtaagagatccactcctttgtgttgtatactgaactaagagcccagactagcatgattgaaacaggaaaagtacgtagatcaatttgtgaaagaaagaaagaaagagagagagagagagagagagagagagagagagagaaggctgaaattacttggttccagcccaatggagtaaggtgggcgtcaaagagttggggcgacatgtaggcgctgtgatccttctcgccttccacattgtgaacaccctgggcatgcctgacctgcagggacaggaaaggattactgatggctaaggaaatacagtacattgtgatcgatgagcagtagtaggagtatttggaaaagcataggaggaagtagtaaccaggtagatggttttgcagcggtggagaggatacatggcggtggtaggaggattggcgtccattggagctcctaaaagacaaagaaaatagaatctgcgtccattagaataacaacagtgggggttaactcactcaaaaaaataaaagagcagtgaaaaggaaaggaagaaagaaatcctttaaatttgcaggaaggaagaaattggaatcggggagggatcgttgggtttggggcccggccggcagtgatggggatttttgtgtggatccaatccgatccgatgggatgggatattgcgaatgtacagatagaggaagaagctaggagaggagaggggatccggagaaagaagtggtcgtatgaatgaatcaggcggggcaaggataagtaggtggaagctatatatgaggtacctgaggaggaggaggaggaggaggaggtgcagcgaggaagaagaacaagggaggtggggaatttggcacggcggcggggaaactgtccgactccgatggtggtggtcgcggcggcgaatacagtgtgcagatgcgagtgctggagcagctggaccattactactttgaggctttcagctcgtgccaaaaaaactgtgagtcgtgtcagagttgggcacaaagaaagaaagaaagaaagaaagaaagacggggatgcgttcggattggctacttggcttgccacttttgtttgtttatttgcccactcacccaaagacacccacagatctggagctgctgcttcgctcctctcctactagcagtagtagtaatactctatgaaaaatctatttactattagccctctgacatcagtttttctgtattgctggaagaaagatggtgcgagagcaagtttaatagtatagccaagtatagccaatgtaatagtcaattcatacaatagttgcttgctatactattaatacctggtcctatatgtcatacacacattaagtcttaaagtccatgctgcagctgactacagatttatagcatatgctgctcttctctctcttcctttaatctctttaaaatatgtttatacagtgtgcagatttcagcgccagatacactgacgttgtccttttttctgtgcaaaagatgcgagtagactacttaataaggccgatcacagtgcgggaacgtggaccggtgctccacctcgccagctcggatgtgggcttgcgtggagcgaggaagcatgccccaacagagccgctcgcccccacggagggcgacaagaaagctccctgttgcgagttcatgcgcggcggagaaaacggctagcacccgcaccaaggacggcgtggcttcgaggcgtcttaccctcgtgcgaagaaatccccggtttgctcacgaaaattcccctcccaccaccgagtcaagaaaaggcaagaaaattttggggattgaaagataagaaattgaagaacatatcgggttcaacaagatgaaaaaaagaaaaaggaagcaaaatcatcacaattcatagggccaaatcggcgttgccccccaaatccgctggagcagtagagaggaggcattgcccccaaatccggcgctgcaactcggatccgggcccttgagtgcagacaacaacgacggcctcctcatcaagtccgccgctcgaggtctccctcggcgaggtcgccacggtggaggcgtcccccgctcgagcgtcgcgtcaccggagtagcagagaggaggaatccaccatttggcatcgcgttgtccactcccgccgccaccaccgctcccgagtccgtgcaggaggagaagcgagcggcgcagtcgacggcgagacgaggcgcatggcagcggcgtccctacgagggaggagcggcgggtgaggtggaggaggcgaactcgagcacgggagcgagatgaagggtaggtgaaggaaatgatttcttgcgctcggtcgtgctaaccgcacccaggtcacgcgcgttgtgagagtagttgctttgcacagcgatttcatccaattaagctacacaacttggggtgcttgcactgtgggatgggtgtctttgagccaactttttgggttaggggtacgagccccatggcttgcattgtgagtgccctaagagcatcaccaacaacttacgtataatctttccccaaaaaattgtttgtgggtttcctaaattgaaaataggaagtaaaaaaaactcctccctccaacagatagcctaaattcaatccccaaaacttgaaagtggacccttctgttaaactacatatataggaaattcctttttttttctttcacgcgcagaaagatcgctttctccacgcgtggaaacgggaagggagaggcgggagtgcgagattgggagcgagtttcgcgtccgcatataaacggagctagaaatcgggagaagggaactccaaagctcgggtaaaagagtaggagatttgttgaagctgttttttttttactaaaatctctcaaaatcagttttggaaatcagataagtagactgttggtgatgctctaagtagctgaagtgaacatagcctggtggttgagctcttttgattccattgtacaaggttcaaatcccaccagcccgaattgatttttcataaaaatgtcatgtgttttgtataaaaacttaaacatttaaaaaatatatcacattttttaaaaatatatttttatttaaaaaaatcataaaatttcatgtgttttgtttaaattaaaaaacttgaacacttaaaataaatatcacattttcaaaatttatttttatttaaaaatatcccgttcagtacatatttaaaaatagaagaatggattaaaaaaactctttacaaagaaaattcaaacagcaagttgataaatatgggtaaatgttattttaaaatgtcacgtgttttgtttagggtttagggtttaaaattaaaatggcaagttgagaactaagggtaagcggaatttttttttgtaaaaagaaggtagaggaggggttcgaaccttggttgcatctgccaccaagctaaaccaaaccacatgctttcacacctatttagacggtacagtggtcagtggcgcaaagatcccttgacgtggagatttcgtgccaactcaaataagatcttggtgcgccaaccccaatgtgccacgagaatgctaattgcgcgtacgcgccgccggcgcgtacgctgccaaaaaaacccataaaagcccgcgttcactgccaaaagcccacacgtatgtttctttcatgttttttttttccatttttagcagccacgtttctttttttcccttgaaactttcaactcagatttaaaaattttcaactcaaaatttaaaactttcaactcgaaatttgaaaactttcaattcagatttgaaaactttcaagtcgaaatttgaaattttcgaagtcaaactttaaaaactttcaactgaaatttgaaactttcaactgaaatttgaaaactttcaattcagatttgaaaactttcaattcgaaatttgaaattttgaagtcaaactttgaaaactttcaacttttcatctcaatttttaaaaactttcaactgaaatttgaaactttcaactgaaatttgaaactttcaactgaaatttgaaaactttcaattcagatttgaaaactttcaactcaaatttttaaaactttcaacccaaaatacaaaaaaattctaactcggatttgaaaactttcaaatcgatattttgaaaaactttcaaatcgtattttgaaaattttcaaaatcaattgttttcatttttttattgggaaattattgtagcattttcactaatcaccatgattaacgctaatggtcaggattagcgacgtcgtcacacgcatcgttaaatgtcgctattgaggatgctgaggcccgcgtgcgcgcgagttagcgtcctcgcgcgtacgcgtgctagccatgcccatgcgctaatgtcacggatcatttctaaaattagtttttatgtggtttatttttaattaagttttatgaaaggatcaatttgttaaattatcggtatattaccactatacttttcatcttaaaaatacttcagtacaagcaaaagcttcgactgtacaagtatacttatctattggcacacatacctactatttacatacacttctattatagctttagcatttatatttatagtcgactaaggcaaagtttgagaaggagatagagaagaatgggaagatacgtaaaatgaggtgagctattagtgcatgattaattgagtattaattattttaaaatagattaatataattttttaaatcaactttcctatatataaaatttgtgcaaaaaaactcaccgtttagtagttcgggaagagcgcgcgtggaaaacgagagaaatcttctctctgtcacccctaccgaacgcagcgtaagtgttcttgcagataaacaaaagttacattaccatgatggccattgccaattcatggacttaaaaatagagaaaattcttcatataccactcaaaatttatgaatttccttatatgccatccaacgaaaatttacatcctttatatgccactattgaggtcaaactgtcttaccttgtcagttttttttttgcgaagcagtagcatataaagaaatacttccttcgtattttaatagatgacgtcgttgactttttctcacatgtttgatcatttgtcttattcaaaaaatttacgtaattataatttattttgttatgagttgttttatcactcatgatactttaagtatgatttatatcttatatatttacataaaatttttgaataaaaagaatggtcaaacatgtgagaaaaagtcaacggcgtcgtagtatcaactttttgatggtatacaaggaaactagtgagttttgagtggcaaatatttgagtgtgttctgtaacgtgtttcataaaaatgtacttccaaaattggcttgtgtggagttgacttggacttggtgggctcgacctctagaagcatcgatctcagtaatgtttcggtcagccatacaggcacatataatatacagtattaattcatgtaagatatccatactccatgtagtagtacaagtcaaaggcgatccatccaatgccaatttgtattttttcttttagagaagttctgatccattaccgaaaggacatgcagaacaaatgctacagcacatcaggcttcagcttgtgggcttgctggctcaaatctatataacctatacaatacaaatgatcctctcatatagtgtagttattaatattttttttatgtggtgttttcacgtcactttaattatctacaagccacataggccttgtttagtttgagaaaaatttagatttaattgtcacatcggatatacagacatacatttaagtattaaacatagtctaataacaaaacaaattacagattccgtcaggaaactgtgagacgaatttattaagcctaattaatccgtcattagtaaatatttactgtagcaccacattgtcaaatcatggcgcaattaggcttaaaagatttatctcgcaatttacacgcaaactgtataattggttttattttttatccacatttaatactccatgcatgtgtccaaacattcgatgtgatgggtgaaaagtttttgttttgggaactaaacaaggccatagtcgcgcatagtcgcgcgttgcgcgactgttgattccgtataagaactatttgttatatatgaggttttagcatgaattaatttatttacaaagtatctattggtctagctaactatacatttaactaaattgtactatatgagaaatcactataagcttcttggtttttattttttttcattatctttgcctcctctctctctgtaccatgtgccctagaaatctccggaaatttccatacgtttatccaattgttattttttagtgcatatgtaactttctgatctaatggctattatttattcaacggttgatatatttttgatgatgtggcgtgttctcatgtaagaaagcttgcagctttcactatataaaataacataagataagatatcaattagaatcacacttaattaacgtcggagatcatcccaaagtcatattattattgatcattggattattttttgttggcttatatttctattagtgatacatgtttcatcccgtgcatttctttctcctcatcatggttagcataaccatgcaacctcaattaatcaagcaaacaatagggcaccaataccatgcataaatctaaacagtcctttaccatcttgttttcaatttgtgtacatatatgcttaatgaacatatcacatgtatatgatagcctatgcatttatggttgtctctaaattatatttaaataaaaatgatcttctgttttaataagatagttcaataatcgatctttcacggtatcaacatactatcataataatagtatcaatttttttctatatgtcaagtttttcttataaattataattaatattttgtatttctattttgacttaagttatagccagcatttttatatatacctaatttcttgtcatcaaaattgcaaacgtaagttttattggatggcactaggtgatgcatgcatggttgtgggatgttgggcctggatagtcggcactaggggccggccaccgccgccacttgggggaggggagggattgatggcgcatggacctcacctccggcgccgccactactttaattttttcgatcgggagaggcgcgagtgttggggtgagaagcagcacaatatacatatatgtactatgggccgatgcacaatatatttagcgggccgccaattgaagcccatttctctggctaactgcacctaatagtgtcaaacttaagtgtagcggcaaaatggacatatccgagggatgattaattgttcctagcagatttgaaaccatggaccggatccacagcgacgacatggtgatggtggcatggctgtggaacaggctagtcctcttcgtatatatacatgtagcagcggttacagccaccctaaaattctcagttcaaatctttatatgagcgaatttcaaattgggttgttgtctgagaggctaaggttgtgttcgtttcaggaggatgggaactaattcctcccgcacggaaaacagaacgatccattagcgcgtcattaattaagtattagctatttttttcaaaaatgttttaatatgattttttaaagcaactttcgtatagaaactttttacaaaaattgtactgtttagcagttccaaaagcatgcgcgcggaaaacgagagggggagttgggaaccccgagatttattcaagagtactcttggcagcacggataaatattagatgtttatttttaaatctagcggtagtttacagatttcactacataagtgatttgcgctactaaaatcttgaactcttctatcaaaagtccatattcacacccaactttttgaaatatgtagctacagaatccataagataaattagcagccaggatctggaaaactcagtttttcagattcttaactagctaccaaatagcaattctatgctcttccaaataggtctgaacctccttatccgttgggttacattttagctagacatgtttggttccatctccctcctggctcttccagtaatatattggatcgaaaagaagtatgacgagactaattggagaattccggccgtcacctagacatcccattaattatttaattaaaatttaaagttagacctgggcgatcgatcgagtacttaaactgatggtacttcagttattagtcgtcaaacctggttaggcgaagtgagactttatatgcaatttagtgccctttataataaagaagaaaagatgagatcgatgatgtgaagttaggtccatcatgtgtacgtgtgttctccttccagaaaagaaatataatcaagtccacacaaagggcataattaatctgtgatctaggccacaatgaaattagtggaaacacctatacatatcaacaacacaaaagctaatctctaattaatacatatgtatactcacatgaaaaggacgacactacttagaaaattgattttcataggctgctcatgtttaactacgtatacgtattgttatagttttgtttggtgaaattataagcacataatgatttaatttattccataaatgaatcatgacattccatatgtaaactagcataaacacatcattagatctacacatgtaaactaagcagtaaaacatgaacagatcaaatatgcgcaacatgtcgaacacgtaccgaggtggcggaaataccggttgctcggcaggaactactcgcggttgtgggcgtcgacaaagacgcgcagcacgcgagcggagaggaaggcgagccgtcgcggacgaacagggagcagtcgcacgaagcgcttcccaaaaaccttattgccgccttctctcggtgcaggacgtcgaagacagaggttccggagacctgctctcccgatcgccggtgcacgccggcgagcgggatggagtagtctacgagcgacggcgcaccacagagtaggaggcaaaccctagattgatttcgcgtgtgttgcgtgaaggcggcggctcggtttatatagagataggtcgcttgatcagggcgcccgcacgatctccactccacgtaacagaaccggataagtcgtgcgtaacttacccggactccacgccgttttcacgcaccggatttttcggaatgtttccaaaacaaaacaaatccgaatttcccgtagcaaaacaaaactgcaaaaggatgctgcatctacgcaagggtgaggagccaattttgcggaccattcgacgcgtacgccgtgcatgcgcgtgttccccctcttctctacaccacacatgcttcaagtggctagtagggaatcctcccttttaaggagatccccctctcctagaataagcaatgtggtactaaactccacatgcatgccatcccatgaggtgggcttttgtgatttttaaaagaattaatctttgagtggggtttagcccatccattaattccaacaatcccccaccaaatctcaaaatcccactgagatttgccttttccaatgtactgtttatataccagcggttcgatggagaccgattaaggttgaacatccatctagaactccaagctacacttactcaacacttgaacaatggactacaccttgaattgcaagtcttgtgcaagcaagtttcactcagagtcttatctggtactagaccgtctataaactacccctcgggtgtagcgtataagtcatactcctaggtctttagtaagcttcctagaagattcacccaaaatctccatagactgcgaccaacagtcaagctcacaaaggtgagttctttcaagaatgctctgcaagacatcatcttcgctaattaaagccaatagaactcattaagtcatagccaagctgccttgcagctcatgagagtacatgcatcttcacttagagagagtatagattagtactctcctctagtttactaatggtttgttcttcccatattctaattcacgagatcttcgatcacatagattgggttacaaccatagtataattcacatgggtctcaaacccatctccttcgatgcattgtctatcacatttcgtgatagtcccttcgtgaagggatctgccaggtttttagctgtttggatgtaatccaacgttataactccgaagtttctcaatttcctgacagacttcaatcgtcttttcacatgtctagacgatttcatattatccttataactattcactttgacaattaccgtttgattatcacagttcataaggatagccggcactggtttttcaacaataggcagatccattaatagatcacgcatccattctgcctcaacagtagcagtatccaatgccgtcagctctgcttccatggttgacctcgtcaaaatggtctgtttggaagacctccacgaaacagcaccaccacctagtgtgaagacatatccactagtggctttgatctcatccacatcagagatccagttagaatcactataaccctccagtaccgcatgatacccagtatagtgaagccccaattccatagtaactttcagatagcgcattactcgctcaagcgcacgccagtgatcatctcccggattagaggtaaaccggctcaacttgctcacagcaaaggagatatcaggcctagttgcactagccaggtacatcagcgagccaatgatttgggagtattccagttgattcctagcaattctcttgttcttgcgaagcaacaagctaggatcataaggtgttggagaaggcttactatcaatgtaaccaaagtgattcaagatcttctccacataatgggactgcaagagtgtaatcccattctcacctctaattagctcaatgtttaagataacatcagctactcccaaatccttcgtatcaaaattttgagacaagaatgatttaacctcatttatcacctcaaggtttgtcccaaatatcagtatgtcatcaacatacaaacacagaataacttccttacccccaccatgacaatagtacacacatttatctgcctcattgactgcgaagcctgcagatgtcaatgttttgtcaaatttctcatgccattgcttaggagcttgtttcagaccatacaaagacttcaacaatttgcacaccttgccttcttgaccttcaactacaaacccattaggttgatccatataggtctcctcatccagctctccattaagaaaagttgtcttaacgtccatttgatgaacgagaagaccatgtgaggctgcagggaaagtagcacacgaattgtggtcaatctagcaacaaatgagtaagtgtcaaagaaatcttcgccttctttatgagtgtagcccttagcaacaagccgagccttgtacttttctatagtaccgtcaggcctaagcttcttcttgaacacccacttgcaccccataggtttacactcatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgtcatcctcctcagtgacatgttcatgtgtatgttcagattgttctggtggtgtgattgaactgggaattatttcagcgggttggctataactactatgtgtatccttcattgggaagaagctctcaaagaaggtagcatcacgagactccataattgtaccatgtcaggtacctcagatttaactattaaaaatctataggcaatgttgtgatgagcatatcccaaaaagacacagtccacagtcttaggtccaagtttgcgcttcttcgttattggtacattgaatttcgccaagcacccccatgtgcgcaaataagaaagtgatggttttcttccaatccatatctcatatggtgttttgtccttatttctgttaggaactctgtttaacacatgattcgaggtcaacaatacctcccccaccatgccttaggtagtcccgcgtgtccaacatggcattcaccaagtcagtcagtgtgcggttcttcctttcagcaatcccattagactcgggagaatagggaggcgtcctctcatgtatgatgccatgttcctcacagaataagtcaaactcgtttgagaaaaactctccaccacgatcagacctaagtctttttatctttctgtcaagttgattttcaatttctgccttataaattttaaaatagtttagagcctcgtctttcttttcaacaagtacacatagcaaaatctagtagcatcatcaatcaacgtcatgaaatattgttttccacccttcatcaacaccccattcatttcacaaagatctgaatgtaggagttctagtggtgccaagtttctctcctcggcagccttgtgaggcttgcgaggttgcttcgattgcacacaactatggtacttagaacctttgacaatagaaaacttaggaattaaacacatgctggaaagccgagacatcaagccaaaattaatatgacataaacatgagtgccaaacattagcctcatcatccacactgccacaaatatggttcacagacttattttagaaatcagaaagggaaaagcggaataggcctccgcactcataacctttaccaataaaatatccatgtttagacacgactactttattagactcaaaaaccaacttaaatccgtctctagtcagacgggagccactaacaagattcttgttgatagaagggacatgctgcacgatctttcccgaagtaaacttcagatctactgtgccaacaccatgaacagaagcatgtgacccattccccattaggatggtggaaccccgtgcgacctgataagaagaaaacaatgagatgtcagcacaaacatgtacattagccccagtatcaacccaccaattagtagactgattaactgaaaaaacagtaggtaaattaccatacccgctttcatctccagtgttgccaatggttacattagtagacttagaagtctgccctgcaggtgccttcatccccttgcgttgtggacacgtcctagccagatgactaggttggccacacagaaagcaagtcctctcatcctgattagtattattgttgttcttcttttgcttcttgaagttggtggtctattgagctttgtatttccccttgctcttattctgggccttgtgcacaacattggcactaaactgcccaccatcgcccttagacatggtgtccttttcccgagctttttcgtcaacatcaagagacgctatcaactcctcaatggagtattcctgtctcttgtgtttgagtgcagtaccgaaacccctccaagatggaggtagtttcgcaataatgcactcggccacacatttgtcgggtaagacacacttaaggagttcgagttccttagccatggtttatatctcatgagcctgctcgactacagaacggttgtcagccatattgcagtcatgaaattgctccatgatatatagatcattgctagcatcagtagcaccgaatttagtattaagtgcatcccacaactccctagcgtcggtcatacgcatgtacacctcgactagacgatcaccaagaatgctaagaatgcatcccacaaagagagtagtggcctcatcgaattctttctactggtcagcagtaagaactcccataggtctaccagcactcacccagaagcatttcgtagctgtcagccacatgatgaccctgatctgccatctcttaaagtgcacaccggtgaatttttccggcctcagtgcatcggcaaaaccagccatagtaaaaccacagtgcctataataagttttttggattgttgaaattataagcacataatgatttaatttattccataaatatatcatgacattacagacgtaaactagcgtgaacgcatcattagatctacacatgtaaactaagcagtaaaacatgaatagatcaaatatgcgcaacatgtcgaacacgtactgaggtggcggaaagaccagttgctcagtaggaactactcgcggttgcgggcgtcgacgaaggcacgtagcacacgagcggagaggaaggcgagccgtcgcggacgaacagggagcagtcgcacaaagcgcttcccaaaaaccttattgccgtcttctcccggtgcaggacgtcaaagacagaggttccggagacctgctctcccgatcgccggtgcacgccggcgagcgggatggagtagtctacgagcgacggcgcaccacagagtaggaggcaaatcctagattgatttcgcgtgtgttgcgtgaaggcggcggctcggtttatatagagataggtcgcttgatcagggcgcccgcacgatctccactccgcgtaaccgaactggataagtcgtgcgtaacttacccggactccacgccgttttcacgcaccggattttttggaatgtttccaaaataaaacaaatccgaatttcccgcggcaaaacaaaactgcaaaaggaggctgcatctgcgcaagagtgaggagccaattttgcggaccattcgacgcgtacgtcgtgcacccgcagggtgaggagccagttttgcggaccattcgacgcgtacgtcatgcacccgcgccgcctgccaggctaggcgagcgagcacgcgcgtgtgttccccctcttctctacaccacacatgtttcaagtggctaggagggcatcctcccttttaaggaggtccccctctcctagaataagcaaggtggtactaaactccacatgcatgccatcccatgaggtgggcttttgtgattttccaaagaattaatcttcgagtgggccttagcccatccattaattccaacactattaagtaaaaactttaaccattaactattgcataaagaatacaaaatgtactatcaaacttagtggtaggggtttattattgaccattttcattagtattacctcatatatatatcatgttgatcactcctcatgtcgcgacgaagatgtcgatgttgagcacacttatccccaattgtcttgcgtatccttgacattgttagtagaaaacaagaaacataaacgaaagtatacatgttcctatttactactaggtagtggaggctcaaaagataaacgctcaaacttttaaccaagctcttacaagttcttactaatgtaagaggaatggtgatatacaccagcgcaaccaattaccctaatgaaggttggatgtatcgatgccttggcaaacacttgttgtgcggctgcaataaaatttgtggaggtgtaggtaggcttatatatgtagcaaaggaatagcaaatactcaaatcagagaaaacaaagttgaatatcgttcaaagacagtaccgtgttggtccttggctagaacgtactaagagacgtgagcctagacacagatgataccacaacatagcactaaaaataactaagcacaactctgatatatgaaagcaatctcaaagataataattaagtgattctctcttttcattccttcttctttttttctttctttttttcattctgctcttttcttttcttttatgtgcggcttttcttttctatttttaagcaaaacagtctcaagaacctcactgcaagattacatgtactcaaatgtaaatataaaaattataaggacttaaatataaaagttcaaacccaaagatttgaactatacaaaaaaatgaagtgatgaagctatgtcagttccatttttgcaaacagattctaaatccgatgacgaaatttttttcatcaaggtgtctagtaactcacggtatggtagaggaaacaaccgtactgtgggggtggaaggatacggtcatttgtccagatttggtgcacaagcacgagataaaatggaaactgacttttagccgatccaatctactatttctgcccgaactgaacataagtacttccaaaatccgttatagtctcttcttatactttttgtgcagcacaaaaaagcatggcaaaaacacacactgggcaaccctatatcaactccaaaacctatcgacaataccctaatgacataaacttctgagaatcgaaccctagcagcgagatgattatgttttcgtaggtcccgacgacaacaaagacacgtcagcgacggtgacagtggtagtatacgtgatcagaactagaaaccctaaatggactggacgctaagaccaacaatacgactcgacgatgcattgcaaaactcaacaaagaaaataccaaaaataacaattcagtggcacaaatatggctagataaatgatggattttttatggttattttcttgttataggtagataaaaattcactaagcaacgaaagctttgataccacttaataaaccctgagctgcacttgatacgctcacggctctggttggcttgatctttcgatgagtggatgattacaatttgggagaagcactaacgatctgactacaaccatacaagatgttgtgttgtgttttagcgaccaatacacctctccgtgggttgttgattttgttggtgcgaatcaaccttatgcctacaagtaaatcgaagaaacaagcaagaacaacacataaacaatctggtgttgcagataggaattgaatacacacaataagttggggttttaaagatgagtacttaggcggtctagccgacatgcgtaactagaatatagagtagcaatagctaaactttaatctaaacaaaacccgagaaaccatgaagaggtatctagctatttaaagaagtgggaggatgaccaagaggttctagtgtcatgcttcaccagattggggtgcactccacatgggctgcacttgggccaggtcccaaatgaagttatgagtccataagaccattataggtgatgcaacaccttgtttttgtgattgcggtcaattgagatggaatttggagatgagactcgatacggatccaaagaggacacctagagttttccatcaagtactgacgggccgaaaataaagctcgtatgcacattctatggctgtttgaagaaaacaatataagcgggtggccgaaccagattgcaccacttggaccgcttgatcttgatgtcttcaaattgatccatgatgcgaacaatcattgtatccatagtaggcatgatcatgtcatgggcactccttgcaagactgttgcagaggccatgccgtagtgccacctcatgtcatacattgctccaccacctaatctgtcaattgtcttgaaagtatctcttttactaacaatgtaaaaggcaattgtaggcactcatataaacatacgcacactcactatatgaatatacacacatatactctaactctacccatatgagagaaaaatataaagattgctttgttcataaagtaatctttggtatatatatggtgagatagaacttattttagtattccttttacaaatagttaataaagggtttagggttcattgttagccataaagggtataaaggcctaaaccctgtatacgtatctgcgggtgctttcttcctagttagtcataaaggccatgcatccatccggttcattgttgactttgctggtgaatctcattattccattatcgatcgatcgtattaattagcctattaatcaaaacacacacacacccgcgcgcatatattaatttatagagtagtatacacacacatatataatgatcaatctctgcaactttcttctaattaattaaactgcataatatatgcaacatgcgtacgagcatgtgcagtaggccaacaagctgcatgcatttgatcatatcttcatttgccatatactagtagtttaaaattaaatcgtactacgttaggacagatagatagaggccagtgcccctagtaagagctacttcaggtgatatacgcaatgatccattccatttcttaaatctggcgtaaaagttagagggtgatgtggatggaggtggaggtaaggtgaagagagtgatcgatgcagccatgcagatagggacaacctacacattaccgatgatatatagttctacttgatcatagaaatatatgttatgaaagttattcttatagtgaatccaaaattatgatgttatacttatatgaatatttaaaaattaatggccagagatacaaatgttaacttaaagatatagaacgataagaaattaatttgaagcgcagagagagacgtaatttaggaaaatatctattatataataaaagttcaatctttcaaacgctctcaagctgctacgtagtgctcccaaaatgcttttaaattatcacatggtgctttaataaaataaaaaaattctaaaaattctataaaaaagcaatagcccttaattttcacttaaattagtcaacacattgttttataacattagcttatatctattgaaaaaaataatccctccctcctaatatcaagaaaacgtacttacctaacctacccacaaagtgtcagtgttacaacctacccacaaaatgtcagtgttacggattagttatacctcctatgttttaatttgtagccaccaggaataccgcatatatagtattatacataaaggtatattcaaatatggggaatataatgga

SEQ ID NO: 69594 - DNA, 36356 bp, Oryza sativa
aaatcaatagctagttgtcagatcaattctcggtgaatactaattggtaggctaaatttagctagcttgctccccattgtaattggtatgatacatcttagagctattcaaataaactggattatggctattacccatctaggggcctaaaccagtataaaaatactttgttccctgtcttttaccgcaatcttgcgcatactttagtatcaacgcccacaatactatactaataccgttgtcgagtataacccatcgatagaattggggaaaacatataaagccgagaaaccacactacatacatacccctgcatagtacgatcatagaaaaaacaaccatccttaaactttccatcataaagaaaactacacataacatgcacaattaaaatagtgctaaatacacgacacatggagctaacatgtgttataaaaaatttccaaataatctcaaatcatattttatggtgtcagataaatgggaaccagggtctccatatcagatacttgggcgtacctgccgcctgctcacgaatgtggttccccggctatgctcggggcatatccgcccacagtgtgttaatgccaaaatttgataaaattctttattggatttggttagggaaagaacataatcaaccgatggaaagcttatctagaagaaaccgagttcaagaaagaatcgtcaagaccacgacatggtagcttaatttatctattaattatacatggtttagtatttttcctttttatctttaggaaagtttgattagtgtctgattaagacttgtgtattatctttaggaattgtgagtcatgtccgattgggactcatatcagcccgagattataaatatgtacacccagggtcttcgtaatctatctccatagaccgatgcaattactttcgacgcatcgccacccttttatcccagcgagttattagtttcgagcatggctgcattggttaagttcgatctccggcaaggaagttccatcaactttgcttgtatcagcctggcgagaactttctcgattaagtctaatattctatctaggttgatgcaagcattgcctatttgatatattgattctatcttcaattgcattactgtttagagttgtataatcttagttaggactttcttagttgggtctgatattctagctaagttggtagttctctaattgtactattattttagatagatttattatatccatcacgtttgtatagatctatcggctaagtaggtttttcttattatctttagtcttatactgtctcggtcaggcccaatctattagatttttgctaataagtttaattcttgtaagccggtaaggtttttatgcagcgttcattggagcgctacccgatgttatcattattttgggcttcaactatcagatgtatcagttagttagccgatatacactttaatttacttacattagatctccagccaatgtatgttttaaccatcagatgtacatctaccacattatattagttttagacgatttgttcacattatattatctcattgcatcttctgagttacatcggcttacactcaaacttgtataatctttagttaaatctatatttatcaacttctatcttatattgtctcagtttggtctgatctatcaagattgcttttgataaagaacggttgtttagttccagccgatgataacatagtttagttccagctggtgataacacaaatctcattgcttatctgattatctgaatttacattagacctatagccgattattcaaaaccctattgacattggttggcctcgcaacatcatatcagtttattggtcgattgactccttgatcttatacgatctatctatctatctatctatctatcttgctagttgcaggatcaaattaattgttatgccctacactggagataagcatatttccaaggccttcgtgtgtcacgaagaatttcacatcagcagggtgcaacccccaagggctatgctcagggcacatttgtcacctaccctccgagagtggccccctatgggttgttgttggtatttattctgaccacataatagtctgcaaacgcacagataccgttgtaaccttcacccaagggtattccaaggtatcgtattcacatggaacgtgtgtgtataatctaagaacaagattcttccaaggaaaacaactaaatggtaggtataggatagagaggactcccatgggttagttatcttaatgaagttatggtaaaactctatcaatttcttcgacactggcgtacccctggtctgcgaaggaaactctgccctatagctctaggctggcaccacctgccgcctgcttctacaacccgtgaaacaccaacaaacaaaggtaaccttctacctagataccggtgccggtgacaatggcaacgacgcgctgtccggctcaagtgctagcaacaagcggtccaaatctgaggtatgggccaactttgaagaactctttaaatcacgcaatggcaatcagattcgccgctaaatgcaattattgccataaaacaaatattcacatgcctcccttccatgagatgggaccttgtaatttacttagaaattaatattgacatgaaccttagcatacacattaattccaacagttcgcagacactactgcatcggaaaggaggaggtggccaatgggggcaagctagggcgtggccaatggcagcctcgcattttttttctcgagtggtgtttgaatcttataaagatgaagataaaaataaagattaagtgtttaatgtaaaacaaggtggtaataatgtatgattaattgagtttttaattattacaaactttaaaaaatcgattaatctgatattttataacaactttcatatagaaagttttcacacaaaatgcaccgcttagcggtttgaaaaacgtgccacgaatatctaaaagtttatccaacttttgttggagaaaaaaacagcgccggtcaccattgtaaagggaaaagtgtacgcaagcggctattttaaagaaccaactctgtataaacacatttgttgttacaccaaagaagatgattatcaatgttaatactgaacaaagacttaagatatattgcagctattttccggaacaattagttagtcaattagggccacaaagggttgaatgacccaacaatatagcaccccggttttgatctatttccaccggccaaccatggattttcggctagaatttgagtccagtgatatatatatctaatttattttgaacgcggccatgtggtttttaagatggctacagtaacctgctgtcgcattaaaaatagaaatacgagagtttataatcaaataaggttgcagttagtcactgttgtatggtcgacaataaattgccgtatcctttagcagttggtgatgttttatttttctaacaaaaaagtatcgttgttgtttattgaattttatttattttcttgtcaattggacgtttcggtcggtgcacttcaattccactaagcaattgaagtgaatcggaggtcgcatgcatgacgacgtggccggctggctaatcattaatcacatcaatgatatatacatggaagctactctctctgtcaaaaaaaaactattcctaccactattcctagcattccaaggtaggatttgtgaagatgaagaatgattaaaatgtccttaatcattggaaaaagtagtaaaggtgataggtaggtaaagggtatcgaagggataaaacttctcgttttacgtgctgagggtaagtaggatgatagaagttggttttgtgtggaacaaaatttaaactctagaagttgagttttttaggacggagggaatagagtaggatcatggatccaaacctccctgtaggatgtagtttttggcattttagtccttcaacgaacttattttataatattagcgtcaacctttgaatggtacgcagaatatatttaggaagagaagagactacctgtttttgaagaaaacaggatgtgactagattgtgcacggtagtgtgttagtctgtttatgcgaaaacatagcggcctagaagttctgcttagctccagtgtaggtccaaatatcgcttcggattcagaacatgtcagttggttcaatcctgcaaccaacaagaataacaatatgtttgaactagtaaacgatagtcaattggccaataagccaatgacgtatcgtcatgacctagccgagccgatgcaactgagctgaatcggctataaagtatggaatgaaaagataaatatgaaagatccttacacatgttccatcagcaacagaaactaacaatatgtaatctataattcaagattttcaagcaattgggatagattgaactaaaccgagattttataaactgcttgtatccaagattgaataaattgcaaactacaagtatttgtatcatagccgataagaccgtttaggtaagaaaagataatgtattggctatagctccgatacaaccttatacaaaatatcaatctaaagcaaatatactaaacaagcattaattctaaatatttaaatctggtcaagattgaatacaagcttagcatatttgaatgaatgattttcttatataaggggcttatataacatattaagcaatattaatcatattaaaaaaacatgtaaaacaaatatattaggtaagattggctaaaactcgaatactatccttcttggcaatcaatgagcaagttagttcttacaattccaaacatgactcagtagttcaaactttaaacccaattaatgcagcactaagtatgaaaggaaatataaggtctaaacaatcgagctcttgattgattttcagggtggtagatacccttactaatctaaatcaatgaaaattgtttagctgatgtcggtgaaaccctaacagatcgagtcgattgttaacgccaaaatttggtaagattctttaatggattcggttaaggaaagagtgcaaccagctgatggaaacttatctagaagtgattgagttcaagaaggaatcataaagaccatggcatagcggcttaattctatctattaactagatgatgtcccacgctttgctgcaggatatatgttaaataatggagaaatgatgaaatgatttggatggaaatattatgaaaatgatttgagaatgatgatttagcatatgtatgtttagttttagaatgaagtaaattgtagatataattactatatgcttgcatgttgagctttgtgtgcttaatgggttgatgtggcatgcttgcttgtaggttataggagtgctaataaatactatgcttgcatattgagctgtaggtgtttagtgggcattagctttatagaaagaagggattagacaagatttagtaattcccttttatcttttggaaagtgtgtttagtgtccgataaggactttatgttttgccttttatctttaggaaagtttgtatggtgtccaataaggactagtatctaccaattggtataaatatctacacctgggatccctgtaaactatctcacgatgaatacaactactcggcgcatcgccaccctctttttcgaggtttttacttatcattggtagaacttggcacctgacgtgggctgcatcgacttcgatctccagcgaagggtaagtcctacattccaccggccctagctattgtatcgactacattggttttgtttaaggctgcattgcttcgacctcttggatcgctctggttcggttgatatatttgcctaccaatttatcatatatcttagttaatctaagtcgattattcaactttcttgtatcggtcagaacttttctagggttttgccagtatcagctaaaatgtttcgtcgatctagattagctaagatatctaccaccctgaaaatcagtcaaaggcttgattgtctagatattatatttcttttcatacttagtgttgcatcaattgggtttgacctactaagtcattcttagaaccatagtctctagcctgccttttgattgccaataagggttccatcggggtttcagccgatgagttatctgaacgttgcatcggcttataagaattacttacaagttggttttagccgattgtaacaaaggtgccattgattatctaatcgtttggatttagtgacatcgaaacaccagccgatgtatgctttaaccgtcagatcagtactcattctattatattattattagccgattggtttatgttggattatattattgttttatacattatcatcagccggttgtctttatattactcaagtgtcagaatctacactggacatacagtcgattgttgaaaaccctatcgacatcggctagtatcgacttattggccgatcaacactttgattttcactttataaatcttgtcagttgtaggatcaaactgactagcacacccgcatcttatcagtattttagacctgcactagagctaattaagcagatctcctaggccgttgtgttcgtcgacttagttcgcgccaacacagatctggcaccatcagccgagtgcgtatttttcgtcaacaccgatataggtaaatagagtcatccacttagattagctaagatatatgataatagacaagtcttatatcttgccaaagatcgaagccaatgcagctcgactcgaaacaagaactcatcgagacaaccaaaaatgaaaagggtggcgatgcgtcgagagtatattgaactattgttatcctccttacaagaccctaggcatatatttatacccataatacaaaactcatccatatcagacacgactcaaacttaacctggctcttatcctaattaacagatacaattatccatattagactcgatttcttgtttagaaatatctacaatctcttctctgagtccgacaaaaacacgacttgcttctatcggcaacacttagtcaacatggcaccgccgatgcctaccagctgattcattttctatttgtccaaccgaaatcatgtcgttgatcccgctcatatcttattccttcttttaacggaatatgccaaattttaccgtcaacataatcctaaccagcgaccactccatcgcatatatgaatccccctttagctaaaaaaattacaatggtgcatgtctttttttaacctttttaatgacctatatcttttaaatcacatattatttttaagatctatttgcatcactgtactctactcaaaatatgtgacaaaacgatatccatattgaatacattcaaacattttatcaattttaaataatttatgtaaattgtagaagtaacttagatattcaacaaaagtaactctctatagcattagaaataattacattatgactgagttcaagtaagaaactatgtggagtaaattcacaagtgtagagaagatttttaagtaaatacatttatgaaagttaattaaataaagtttgaaagtaatttttataaatcataaaagtaacttagtaaaaaaggaagtaagttgttacaacattagaagtaaatctgttgtagggataaaaacatgagtttatttggaaattaaatttaatcaacacaaattatgaaattgactaaaagcaataataaaagtatcaactcagagcattatgaatgtatagctagtaatttaataaaatctaaaattaatttatatatatgataaaagtaacttacatatataataaaagtaagttgcatatgtaataaaattattttacaaacataaatattttttcatcataatataatcatgtaagatcttgttataaagatttaattgcaacgaacacaatagtataatcggattatagatctataataagtaatttaagagaaaattttataaggaaaaatggacatgtatgacataatagaaaaaaaacatgcatgtctgtagatatgtagtagtacttctctgttgtatggctggcatcatttgttaagcctagcctatcggagttggattcttgagttggggtttaacagccgctcaagcgaacgaaactagtgtggcggagtgatttacaacgagggcaacatagctctaggtggtggcaaagagaaggctaggagtgtggagattatggataccccatacctccacggcatgtataatccgactgggtatggggtgctgtgacatcctggcccagggcttaataggattaatagaatactcatataaacaagttgcaacttctttttcggaagccaatctcccaagaactccagggttaagcgtgcttggcctggagcaatttgggatgggtggcttggcctggagcaatttgggatgggggaccgaccgggaaattcttcccgggtgtgcacgagtgaggacaaattgtgcagaaaagactattgttggtctgtgagggtagtctatatcctaggatatctgccagatgtagagagggcccggccttggagagtagtgttggtctgtgagggtagtctatatcctaggatagctgccagatgtagagagggcccggcctcggagagtgtgttggtctgtgagggaatcctaggatagctgccagatgtagagggtagtctatatcctaggatagctgccagatgtagagagggcccggccttggagagtgtggggcgtcacagatggtatcagagccaacccttgcagctatacgtatatatgaatatgtacgcgggcatacggtgtatacaggatgatccacgatgtggtcgtatggcatgacgtatgtgcgccgaaaattgtgtgtatatacgtggtgctaataggggacgttcctggcctgggttgaccgacgaggacgtcggtatcttaagggggtgagaatgtgacatcccggcccagggcttaataggattaatagaatactcatataaacaagttgcaacttcttttccggaaaccaatctccaaagaactccagggttaagcgtccttggcctagagcaatttggaatgggtgaccaaccgggaaattcttcccgggtgtgcacgagtgaggacaaagtgtgcagaaaaggtgccatgtatcgggaaattcttcccgggtgtgcacgagtgaggacaaagtgtgcagaaaaggtgccatgtatagatagaatatctttaaagggactcggattaaattccaaacttgtacgtcaaggaaatacccggatcctagtcggttacgattgtatcttatctgtagctacctattccgttaaggatatgggctgtactttgtaatacggaccccttcccctatataaggaggggttcgggtgcctctcggggcacgattttttcccagatcatacgatcaataatacactcggtggatcaatccccggacaggagtagggtattacttcttgattaagaaggcctgaacctgtataaaattccttgtctctaaacccatccacttttccagcttgatagccacccccttttagtattgccgaaatcttgtttcgatagttggcgcgccaggtaggggtagcgtcaagttcttcgccgactagtgcgatgggtttcgtctccagcatcgacgacttcgtcttcccacccgggcaggcgttccagttcggcagcctcgacttcatcaccaacgacttcggcaagatttctctcctcgactcggattcgaaccagtcgggaagaggccaggtctccgccccgttcggtatcccgaactcggccgagatctaccccaagatcatctcaactgagttggccccaaaccactcagacgagatccaatctactccaacacgatctgatcaaggcgatggagcctatccgccaatcctgatgaaactccccgatgatttggctgctgtcttcaccacaagggtgtcttctccccgtaggtctaggctggatccggccccggccccgatccagtctagctccagggaagtcggcgtcatactctagcctctcggcacggtttcgatggaacaactagacggctacctcagctcccctggtgtcgactcacgaccaacggagatcgtggagtacgacgacttcggctaccgctacgaccaccacaagctcgacaacttcaacgaaggctttgaagacaactacacacccctctacttcggcattttcagaaccgacaatgagacggaagaacagcgtcaagcccgagaagcagaagaacagcgcgtgcgacaagaagccgaacgacgccgactggaggaggagcgccaagcacaagagcgagaacggctacagcgtgagcaacaggagcacgagcgggctgcaaaggaggctgaggaccaatgacaacgcgccttggaggccgggcgacgagcacgagaactcatcgggcagcaagacgtcgatgggacggcggtttttcgcaccccacaacagaacgcggatgcagcgatcacccttctcgaaacctcctcaaggaagacgcacttaaccaagccaatcacgtcgtcaacatcttgaaccagaccaagaccatgatcgcagcttcagtcccggttaactccgcgagcgtccgcacgccgactggcaaccgagttccccctcttcgatctcaagactatcaccaaccaagcatcagcgtcgtcagcgtgggatccagtcgcaggagcagggatcacgacgagcgatccgcccactcgcctcctgaccgacgcagggagcgtcgagctgaacgaccccgctccccacatcgcaggcgtcccatcgatcttcgtgatactatcaaccagcgccgcgcgacgagaagctacgtcccccaccattcaccagatcgctacgacgacgacatggatggagttgctgccttcacaagcgacatgcgtcgagtggattggccagtcggcttcaagccgactggaatcgagaattatgacggcaccactaacccagagtcttagctcaccgtctacagcctcgcaatttgcgcagaaggaggagatagcaaagccatggcaaactatctgcccatggccctagcggattctacccgacaacgttcacgtgtcaacacttttgacaagatcatgaattcccaatgtctacatcatccaaattccaatcacacggccaaagattgctttgtctacaagcagttcgcacaataatatgccaagaacgcacgcaagacgactgacggagatcaaagcacgtcaaagaagaaggatgatgaagatgatgccccgactggttttcaagaccatcgcaaggaatttaaccacatctttggcggacccctggcttatgaatccaagcgaaagcaaaagctgaccgaacgggagatcaatgctgttcagcccgacacaccccaatatcttcagtggtcagagacagctatcaagtttgaccgctctaatcaccctgaccgagtggtccacccggggcggtaccgcctggtactagacccagtggttcgcaacgtcaagctccgacgatccctcatcaatggtggcagtgcactcaacatccttttcgccaagactctggacgacatacagattcctcgcacggaattgaagccgagtaacgcgccctttcacggagtcatccccgggctgtcttctactcgactcggccagatcactttgccggatactttcgacacttgggagaactttcgcacagagaatatttgcttcgaagttgctgatttcgagacagtgtaccatgtcatattcggacgcccggcgttagccaagttcatggttgtcccgcactacacctacatgatgatgaagatgccaggtccccgaggagtcatatccctacggagcgacatcaagcaagccgtcacttgcgacaaggaaagctgcgagatggcccagacccgcgagatcacgctcgcccgagaaaagatccgactggctgcgtccacagcaaccgaatgagaagtgcctgcaaccaagatgacaaagagcggagaaggcgacgccaagaccaagaagattcctctagatccctctgatcctacaaagactgttgtaataggcgctgagttagattgtaaataggaaagcgcgctcatcacctttcttcaaaataataacgatatctttgcgtggaaaccatctgacatgcctggtattcctaagagaggtgattgagcactctttacatgttaaggaagatgctaaacctatcaagcaacgactccaccatttcgcacaagataggaaggacgcgatcaaggaggaactgaccaagctgttagcagcaggcttcatcaaggaagtccttcatcccgactggctggccaacccagtcctggttcggaagaagacggggtaatggcgcatgtgtgttgattcaagtcttgtcccaaagatcccttcgggttacctcatatttaccaggtagttgattcaacggccggctgcgagctactcagttttttggattgctactcaggatatcatcagatccgactaaaggagtccgactgcttaaagacttcatttattacaccctttggggcctattgctacatcaccatgccttttggattaaagaatgcatgagcaacttatcaacacatgatccagagatgttttttcaactcagatcggtcgtaacgttgaagcctatgttgatgatgtagtcgtcaagaccaagtagaaggatgatttgatcacggatctagaggagacttttgcgagcatccgtgctttcaggatgaaattaaaccctgaaaagtgtatcttcggagtaccgtcagggaagtttcttggctttatggtatcccacaggggcatacaagccaacctggagaaaatcaatgctatcctcaacatgaaaccgccaagctcccagaaggacgttcaaaagttaactggttgcatggcggcgctcagccagttcgtctcacgactaggcgagcgggggatgcccttcttcaagctgctaaagaaaactgacaatttccagtggggacccgaagcacaaaaagcctttgaagacttcaagaaattcctcactactccaccggtcttagcttcgccacatccgcaagagccgctgttgttatacgtgtcggcaacttcccaggttgtgagcacggttctggttgttgagcgtgaggaggaaggccatattcaaaaagtacaacgaccgatttatttcgttagcgaagttttggccgactccaagacaagatatcctcaggttcaaaagctattatatggtgttttaattaccgtcaggaaattatctcactacttccaaggtcactcggttacggtggttacatcatttccatcagggatatacttcacaatcgcgaagaaaatgggcggatcgcaaagtgggccttagagttgatgtcttttgatctatccttcaagccacgaacttcgatcaagtcccaagctttagcagacttcatcgccgaatggaccgagtgccaagaagacatgcctgcggagaagatggagtattggactatgcataggagcgggggttgttctaatttccccgactagagagaggttgagctatgtattgtggatacatttttctacatctcgcaacgtggcggaatatgaggcgcttcttcacgggctaaggcttgcgatctccttgggaattcggcgtctgatagttcgtggagactctaagttggttgttaatcaagtcatgaaatagtggtcctgccttgatgataacatgactgcctatcggtaggaggtacgcaaattagaagataaattcgatggccttgagctaacccacgttcttcgatataataatgaggcagccgatagactggtcaattttggttcaaaacgagaagcagctcctcccgacgtgttcgttgaacatctttatgagccaactgtaccaagggaagaaataaacgaggccacggacgctcgagacgtaagcatgattgaagccaactggagagagtccttcataagatttttgaccaaacaagaactccctcaagataaagacgaagccaacaggatctccaggcgcagcagacattatgtcgtacatgagaccgagctgtacaagaaaagtccatcaggaatcttgcaacgctgtgtgtctttggaggagggaagacaattgctaaaggatatacattcaggcatctgtggcaatcacgctgccgcacgaaccatagttggcaaggcatattggcaaggttttttctggcctacagctgtatccgacgctgacaaaattgtgcaaacatgtgagggttatcaattttttgcctgacggactcatctaccggctcaagagttgcaaaccatcccgttgtcttggccgttcgcggtatgggggctcgacatggttggcctgtttaaaaaggctgtcggtggttatactcatctcttcgtagccgttgacaagttttccaagtggatcgaagccaaaccggtcatcataatcacggtagacaaggctagagatttcttcatcaacattgtgcaccgatttggggtacccaatcggatcatcactgataacggcactcaattcactagcggggtatttaaagatttttttcaggacttcggcatcaaaatttgttatgcctccgtagcgcaccccatgagcaacggacaagttgaacgtgccaatggtatagtgcttcaaggaataaaagcacaagtttttgaccgactgcatccctatgctggcaaatgggtagaacagttgccatttgtcctttggtccctgcgcaccacacctagtcgggcgatgggccagtcgccgttttttctagtctatggagcagaagtgatgttgccaagcgaggtggaatttgagtcgttgcaatttcgtaatttcagcgaggagcgctacgaagaagaccaaatagatgatcacaattggttggagaaagcccgtgaagcagccttaattcagtcggctcggtatttacaagggttgcgccattatcacaatcgcaatgttcgatcacgagctttcttagtcggcgacctggttctgaggaaaattcagactacaaggaaaggaccgttcatagtttctgaagttactcagccaggttcttaccgactcaaacgtgaagacggtactcatattgacaactcttggaatattgaacatcttcgtcgtttttatgcttaggcattattttttgtatcttcctctttgactgctaacatcaagttttttttcttgagttatcagtcgggggctattataataataatggagtgtgatttttatcaattcaatttgcttacttgatttatcattgccttgtttgattttttttgtcttagtcaatgaggactgaaagtttttaacaacttttgcgggttttaggctcaatgaggtttgacaaaaacttttaagaaatcaggagctaagtttgaaacatcaagcacagcataaattcatcagtattgtacaaattgtgcctccatcatcatcatcatcatcatcatcattgttagaatacaacatcaatcagtatcattcttttcatcatcagagttattagatccagtcggcaaaggtcgttgtcctggaatctctcaacaacatcagcagctatcttatcagcagctttttgtgcgtcattgataaggtcaagaccagcttcttcgcttgtcccgtctgcaaagccatcaatggcatcaatatcaatcttcgggtacaaggacttggtcatcgccaacgccaggcctgctcccatgtttccagcttccttgatattcttaaaatatgtatccggagcaattctcagcttgtcgaagatctcggcagcgtcaaatgaactcggaccattgttattgaagaacatggcttggacaagtgcatgctccctttgcttatttattacaattccttgtggtcgcatttcatcatcccaccacttgactaatattggtgggcaagaatcttcagccgatcgtatccggaggagctcctcttcatcaccaatcaatggcccttatatattcatgaataatggtgaagtaattgaataaaggttgtcggatcaaagcaggtttggaggacttgtttacctgtgataatttccggtcggggacgagcaggtcctttcaacctaacaggagaactagttccagggtcagcaccaatgtccatcttgggagggctgttggcatgagcttccatttctgggatatctctattatgttctgtacccgattggtttctagtcgggggctcctgatcagcactggctttagcttcagccgactggtttccagtcgggggctcattcctggtatctacattgccggttgccagttgattattacccgggcggttttcggcagttgacccagtttctactgaaggaccagtctctatgccagtcggcgtggggtcttttccagagggatctatgtcagatggttttctacaaattttagacacgttatcaactctgtttcaattgtgagtaactagtaaagcaggggaaattaccagaggacacatacctggatgacttcctgatttttggcatgggacgactggatgttttcttcttcggattggttggctttagttgttttccaatcacccctttgttgcccgtcttttccgcgtcatcaccttcatcgtcacttgaaaccagcttcctcttacgagaatctgactggttagtcgatcttgaggtgttgggttggacgtccgactgaatcttcggccctccgctggcttggccagtgtgccggtgaggtgagcggcgttgagcaattggaggatcggacttcatcaaagcgaattcctgtgcatggtcttccaagttctcagtcgactttacagacgataaaagcatgctttgagagaaactgagttgtataatacataccggtggaggagggttgaaggcactgtatggcacaactggcaataagtgtgaatagttgaccactatggcattcgagaagattttgtacatcctctcctgcataattttgaactcaagagattctgggttctctcgattggggtcatgcttgccgtcaaactcaaaggctgttctggatctttccttgattggtgccagccgggtcttgatgaagtgccgggtgatttgttccccttgcagactttgttctttcagcttaagcatgcaatccaacaagtcgagcgcttgggcggcctcttctcccatcggcagtgagttccaggtatcgcgatagactgggagaagacaggagtatccgggaagcgctggctcagggttttgcacatagaaccagttcgtgtgccaacctttgttcgaggtcttgaatggcatggagaagtatttttggctcaaggtccccctctgttgaaatccggctcccccaactacgcatggtttgcttttgtttggctggggtttgaggaagaagatgcggcagaataaagcgaaatgtggcctaatccccaaaaaagattcgcaagcatggatgaaattggcgatatggactatggaactggggtttaggtggtccaggctgattacatagaaatccaaaattcctcggaagaaacttgaggtcgaaagagaaaacccgccataaaagaaatgggagaataccaccacctcgtgtgtgtcgggggtcgggaacatttcaccgtatgttggacgccacccgatgatctcttttgccggaagaacgccgtgcgccaccatctccttcaaattctcctccgttacatcggagggcgcccactgactttcaaagctttctctcttccgccatggatgcgaactggatggtatgatttggttcggaatgtggctgggaatgaatgggagattgatgcggtggttgcgtggaagatttttgtggaattttggaggacggattggagcgaatcggtgaaccctagcttcgccggtgcggtttcgcactgtagcagggaatggggaaagtggcgatagtttcggcggggaagacgaagcgacgtttggcttttggtattattagggtatcgggagtactaatgggcctaggcccaaaacagtacttcagcccactttttttttctatcagcgtggctaagttgtgatccttagggacttaggcattttgcttcggcaatacttgctcgcaacagtgtagcccaatgctgctaaaatcctttttgacgcagttagataattatttggaattactacgatgcaaataaaaaggtgcccaatggaaaagtgttatactaatttttgctagcttttttaggcagcaaaagctgattgggttttgttgagatgactggtttttgagcagtcattctctcggcatgttatatgcttatctagattatggcgtgagtcatagcctaggctatttagactcatcaattgtcatgaaatcacatttataccacatttgatggatcctttaagagtttttacttggattcttgtcatatgtgttgatttatggacctttagagtattttttactcaggcctttttatatttccatttttggtatattaaagctaaagcagtcggctggatgttttattaaacgccgcatatgcttagctgtatgatacttttggacaatttggttgtaaaaccactcggatggatgttatttgcgccttgactatatgtttagtctttagataatcacatagtcgggggctacacctaattaggtgcatctagtcaatgcacctgattttttattttcagcccttcatagtctttgattttggtactcgggagatcaaggcagaagaagtcgaagtactcggattatcattttggattacgagacaagactatttcgtcgactataaaggtctcaggggctactgtggagattatggataccccatacctccgcggcatgtataatccgactgggtatggggtgccatgtatagatagaatatctttaaggagactcgggttaaattccaaacttgtacgtcaaggaaatacccggatcctagtcggttacgattgtatcttatctgtagctacctattccgttaaggatatgggctgtactttgtaatacggaccccttcccctatataaggaggggtccgggtgcctctaggggcacgattttttcccaaatcatacgatcaataatatactcggcggatcaatctccggacaggagtagggtattacttcttgattaagaaggcctgaacctgtataaaatttcttgtctctaaacccatccacttttccagcttgatagccacccccttttagtattgctgaaatcttgtttcgacaaggagggagctcaagagatggagaaacgcgataagaaggggagggggatttacccgctcgctaatgactagtaggaccgcatatgagaatatggttatatttttcaagtgtggttttcttgagtgaccgtattttcagaggtaggtttagactatatgaccttcttatcattactggacttttaatgggtcgtctataaatataaaactttgtacatgtaaaaagctgtggtgcggtcattgctcaaccgatcgaatttggtgcggtcattgctcaaccggtcaaaactacattagcgaaaagaggatcccaagatcccaccaggataagccatgtcatcatataaatataaataagaaccgttggatgcacgatttgaatgaagagaacagttggatcataagagagaaaaataagtaaaaaaaagtgtcagggttatggataccatatacctaatagtagttgactaaatctcggcaagacctaccacataccatgtcttaaacggaaactgacctcggatatggagggagttctggataaggaaagacaaccagagttctacatggaaacgacaaggactactcggattgtatccatattggtttccctagttctacttggacaagggaacacctatgagtataaatacaaggccccctaggaggagaggagacacagaacaatagatcaaggcggaagatcaacatacaagccaacatacgccaagacaatacgccagatatcgacttcagatattggcatggctagtcccctacggtgcctatgtctaccgtcaggagagatatagcactgtctctgatctcgccggatgtggattcgagcaagaaggctaccctattgtcgactacgagtcagtactacaaaccgccaagtcgacaacagttagataggctaccccaaatattgtactggtgtgattatgatgaataagagcagtaccagcttcggccaacaggatgtagggttattacctgacaattcaggggcccgaacctgtataaaaatcctcaacatacgccaagagaagacgccagatatcgacttcagagattggcatggctagtcacctacggtgcctatggctaccgtcaggagagatatagcattgtctctgatctcgccggatgcggattcgaggaagaaggctaccctgttgtcgactatgagtcagtactacagaccgccaagtcgacaacagttagataggctaccccaaatattgtactggtgtgattatgatgaataagagtagtaccggcttcggatgttgggttattacctgacaattcaggggcccgaacctgtataaaaatcctcatctccgtatcttttacctaagtctcgcgtacatcctagtgccaacgatcctcatattatgcaaataccggaatcgcgacatcatacgtcgacagtggcgcgccaggtagggccgtagggggatattggtgctttaggatttcgacgagatgggttcgagaagatggattcttcaacaacaaactactcaacggcttcgtatgttgggtggtatgacccgaacgaagtacgttcttcgacggatcgggatcttcgtcaagcttgccaagtcatcggcactatggattctttgacgagagatacttcaactactttggatctgggaagtctaacctagccagagtatgtgccccaacaaggtcggaaccatcatcctcaacaattcgatctctcgagatcgaccaagcctcaagatacttgttacaatctatagtcaataaaacttgttctcaggaagttcttacaaagccaatcccaacacctggtaatgaatttcggattgtccagtatgcagatgatactctactttttttgactgcttcccaaaaagagcttttctatctcaaggcaattttgaacacttttgtctcttcaactagccttaagattaactatagtaagtcatgcatgattcctctgaatgtagatttggaaaaggttgatcatctctcaaaattgtttggttgctctattggtagttaccttttacttatctgggtcttcctcttggaaccacaagaccaagagttatagattttgctcctctagttgatagagtagagagaagactctcagcaaccactgctttggtatcttatggggacagattgaccattgtgaatgcagttctttcctcccttcccacttactacatgtgctctctttcactttcaaagacagttatagaaagtattgatagagctaggagacattgcctgtggaggggatctgatattaattctagtaggaagtctttggttctccgggaaagagtttgtcagctgaaagatagaggtggtttgggtgtaatagaccttagattgcaaaataatgcccttctcttgaagaatttgcataagttctataatagatatcctgttccctgggttagtttgatttggaatacttactacactgcaaaacctcctcatgctgttactcctaaaggatctttttggtggagggatgttttgcaatttgtggatatttttagaggcatctcggcctgtactgtgcaagatggaaaatcttgtttgttttgggaagatttgtggaacaataaagtcagagccttggtttatcccagaatatattcttttgccagaaattcaaatctctcagttctgatgttctctacttctgatctacctcagctctttgccttgcaacaatcagcgcaagcttttcaggaatatttggcaatgtcagctgcagataccttggagcatcttaatgatgagagtgatcgctagacatatgtttggggcaacggtatcttttcctcacagaaaatttatgccatgaattttcctcttgtccatgtgcctgtttatattaaatggatttggaagagcagttgtactatgaaagtcaaggtgtttggttggctactctcgattgatcagttaaatacttatgacatgttagacagaaggcattgctcccctcaaaatgcttccttgctctgtgtactttgttcaaaaggatcaagggaaacaattctccacttatttttccagtgtccttttagcactcaatgttgggcgcaatttggtgtggtttggaatcttcctttaagctttggtgaaattttggtcacagccagaaattcatataactctacccattttgttgagaaggtgctttatgctgcttggaacatttggaagcagaggaatagtttaatttttgaaaacattgttccctctgttccctcttggagagttctctttaggaatgatctctcccttttagttcatagagtcaaaaattctgagagagatatattgttacagtggttaaatttgttgtaatttttttctcctttattaatataaaatcttaacggtgggggcttcccctaccgtggttctttcaaaaaaaagatacgcggcgtaccaaaagatgtcataccgtatgatgtcgaacgagtacgcaataaggtaattggtagattggttttttaaattaatctactaatttcgtagatacatccggcatgtatctacaaaggtaagcaatattttatatgcaatttatcgtacctattcagatcatacaatattgtcatatctctaatttattatgtttacctagagcatgttttttatacaatatctattgtgcaagtgcttccgatgttaggccaactacggtctaacgctgggggctcgctctgctctcttctatatgaatcatgcttgtctacggtttacataatgcctgatatttaatatgctcgttatatcctgataatactagaagatccatgcagttttttgagtacatactcgatattttctgctatatgtcttgtcttctagaaaatattttttaggaacaattgagcactcgagtaggttgtggttgagtacaccgcattatcgagaacgttctcgaaaaatgcagagttgttgcacacaacctaccaacgaagaccgacgacctatctcatagcaccaaccatggctaggctattcgagaaaaggttgttaacggataaattctcgtgaatgttgtcggcttgatcacccgacatgattgcgagtggacatccggatatgctataagttgggtatgtgagtcatgctggccacatgagatgcacatgtaacaaaccaactttagcacccctataggtgattgagaggctcctactcctagttctcaaaccagtaggacgtagcgatctctcgcgccttaactcctgatggtcgaggtacgacaacggcaatagcgtagcggccctcgcaccacgacttcagatgacttcagatggttgaggaacagctacgactggtcttcgaccggcagcgtagcggccctcgtaccatgactccaaatggtcgagagacacctactcactggttctcaaccagtcaatcgtagcgatctctcgtacatttacttctagtggtcgagttacgactactacctggtcctcgaacagcggtgtagcgattctcccactatttccactttaagtggtcgagttaaggctacacctggttctcgaccagcagtgtagcgatactcccactacctttacatctagtggtcgagttaaggctacacctggtcctcgaacagtggtgtagcaattctcccattattttcactttaagtggtcgagttacgactactacctggtcctcgaccagcggtgtagcgattctcccactatttccactttaagtggtcgagttacaactactacctggtcctcgaccagaggtgtagcgatactcccactagctttacttctcgtggtcgagttaagactactacctggtcctcgaccagaggtgtagcgatactctcactaactttacttctagtggtcgagttacgactactacccggtcctcaaccagtggtgtagcgattctcccactacttttacttcaagtggtcgagatgtggctacaactagttttcgaccagcggtgcagcaatcctcccattacctctactccaacaaagttgatatcaggtatatcaccaagtgttttacccagagatcccttaccacgatgacacctagaattgaaacctatcctcatgtccctttacgttgtcttgacaaggcctctgaggaacctaagggaacttcggctggggacgcccagagcggataaggccttgtcggatcatgtagagacaaacgaccatgtaagacctggtcatgttagaattctcgccgtgcgtattaaccaagccgtgtaatcggaaattgagctttccaacttcacggctgggggctagggtcagtgcttttttcaaccaaggcaggtcaagggtccaagagccttatcctctgagaacgattctccgacgataaggctgggggctagggagagtgtatgactcaacaaactgactgatcgaagtcggtaaaagagaagacgctcgtacacaaaacattggtctgtaaatttaattcattttcagttttccatacatattataacatgtcaccctttgagcgttcgctcgggggctatttctatctaatattcttttctgagtattgatttcaggaaaattctattcaacattgttgaagactccatgtctctatggttctacaccaagatcgactaaggcgagtacgatgaatgttgatgaggcttcgtcgcagattctatgccttctcgatcactcgagaacggttggtggatctcgacaaggaatacggaatgaagagatggtgtacccgtcgagataaaatttcttgacttcaatccaaattctcgattacagcaagacgggagacttaatcgtatgctctgtactttcttggttgacgtcggagattgactcggacaaaccctataggtgcccgcacgaggctgataagggaagtctagcgttatctctgaactcaccgagaacggtcacgtgagctcgataatagttactccaaggtctgcggttgagaatatgaatttgttcatttgtattaaagtcgggggctactgtcagggttatggataccacatacctaatagtagttgactaaatctcgacaggacccaccacataccatatcttatacggaaactgacctcggatatggagggagttccggataaggaaagacaaccaaagttctacatggaaacgacaaggactactcggattgtatccatattggtttccctagttctacttggacaaggggacacctatgggtataaatacaaggccccctaggaggagaggggacacgaaacaatagatcaagacagaagatcaacatacaagccaatatacactaagacaagacaccagatatcgacttcagagataggcatggctagtcccctacggtgcctatgactaccgtcaggagagatatagcgttgtctctgatctcgccggatgcggattcgaggaagaaggctaccctgttgtcgactacgagtcagtactacaaaccgccaagtcgacaacagttagataggctaccccaaatattgtactggtgtgattatgatgaataagagcaataccggctttggccaataggatgtagggttattacctgacaattcaggggcccgtacctgtataaaaatcctcgtctccatctcttttgcctaagtctcgcgtacatcctagtgccaacgatccccatactatacaaatactggaatcgcgacatcaaacgtcgacaaaaagcaaataatgtcataggatgttctagacccttcaaacatatcccataaaatgtgtggaaacaaagatatgcgaatgaaaaaatatcttcaaaattatccttataaaataatcatcaatgagtattcaatagtaattaactcattcaatagtaattctactgtatcaacaatagtaggtatccgtgaaaatatgaatagctacataacctaatactatcgattacttcactacagcttgaaattaaaaaaaaatgtgacatggatgacataataaattttgcaaagctgatttcaatcatatgattataagatttactattaaaaagcgtatatatacttctcaagtggtgatgacagaattgtaacgcgtaagaaatgtagctatttacattattactacaattgacacatttatttagatattgtaggagataatgatcgcggtaatatatgataaattatttgttgttacaatgatattcttaataacaaatcaagatatataaatccattactgttatagctacacttcttaaaaaaaataggttaaaacatatttattattaattgttattaacatttatatctattaacataaataatatataaatatatttaatagatggagaggtcatagttgtgtgaacacacaacttatgttgctagttcttcagccacgtgaaccggacatcacaaaaaaaaatgctgataaactactggccatgttggtttgggctgtgtttagttgttttggcaaaaaaaaaatttaacgtacacggacaatgtagactaataacaaaacaaattacagattccgcctgtaaactgcgagacgaatctaataagcctaattaatctgttattaacaaatatttactgtagcaccacattgtcaaatcatggcgtaattaggctcaaaagattcgtctcgcaatttacatgtaaactatgcaattagttttttttcatatttaatgcttcatgtatatgtccaaacatttgatgtgatggaaaagttggaagtttgaacgtaaacctccgatgatattttaaccaaacatgtttttaaaatacaatataaatctcttctattaaatgtttggtcacatgtatggaaaattaaatgtggacgaaaaaaccaattgcacggtttgcatataaattacgagacaaatcattttagcctaattacgccatgatttgataatgtgatgctacagtaaacatttgctgatgacggattaattaggcttaataaattcgtctcgcagtttagagacggaatttattgttttattattagtctatgtttaatattttaaatatgtattcatatacttaaaaaaaatttggcacacgaactaaacacagccatatcgatatggttaaagagatagggtagcaggctgccgtacgtcgccgatgattcacctagcagagccgcagtagtagagtgtacagttttgaatgcgccgcaccagccgcgctacccctcctactagtacgtacttaccgcagcaagctagtggtagacgttattctctccgttgtattttgtattttaagtgcagctatttttttcctaattttgattatctgttttatttaaatatttttttaaaaaaattaaaaacataagtcacgagtaaagtactattcatattttatcatctcataacaacaaaaaaaatactaattataaaaaaaatttcaaataagacggacgattaaagttggaacggaaagtcatagctgcacttaaaatgggacggaggaagtagtctacttggttcgatcgttgacgagagaaaaacaaagagaagaggagaatgagatgagccatgcatacggttgcgcagaataagaccaagaccgaaaaattcgttagtagtcggtttcaaccagtgaaataccaaaatatattctgtcaattcaattagtgatatcggttaaccgaattgacccatgtggcctaacctagtgggcctaataagcccactaattcggcatactaaaccttagaggcagggtagagagctgctcctccgcctccatcgttcctcggttcacaccacctccgtctccatcgcgctcacgcatccatcctctgcttgactacatccatcgcaccgcctcattagcgtgcaccacctcgcgcctccacctccaaccagcctccgccttcatctcttcagtccccaccctcacgatcgagtttcaggaataaaagagagagatagagagttcggagctcctaaacgtgcggcgctgccatcggcgacttgcactgcactgagatgaatgggatttggaacttctcgtggagtgatgaagatcgatgggatacaagtcatggcaagattaatttgcttctttttttcccctatgagtcgtgctcttttgctactagcatcgtatgatagttattcatttgagttgctttgattcatcaatgttgtatcgtcgacttatttatttttgtgattaattcttttgttgtttaaatcactgttatgggttagttcggtccttaatcgaaaccaaaacaaaataactgaagactaaagtgctcggttttgaatttttttaagatcgacaagtcttgtgattttgaagattgaattttccaaaaaaaaacagagaaaccgagctgaatttgtcggttaaatcgaatagccacccctagccgtgctgccggccgcagcacaagtgcactgaggcaaaggcgagaacacacgtgtcctgtactccagtgatccagtctagtcctagccggtcggtccaggccggtccagaccattctttgctggaatggagaccttgagattaacaaaggagttgacccttcagcccttcactctagaatagtatataactaggcaatgcttcatcaacttgtactctatttatttttaaaaaaaggaaagaaaacttgtactctattcatccaggcctttccttttctaaggaacggaagaacggagtaatgtgacattttccaagctacgaaaactatttcgtacagtttctttaaaaataatatatcaacttttaaaaacccgatttttttatttgtaataattaataactctaaaattaaataagtagtaaacatagtttcaaaattatagaaataggaaggacgctcttccgtatagcgtccagatatggacgttgttgaggactgcgtccatgtgcggacgccttggcgatagcgtccagcatagtgggctgctgcggacctaacctgggccgatcatcaaacaaccgagtcaataagcctaaaaaatacaaaagccgggtcaatagtttgatgatcaatgatccgaatgtaattattgatcggccttcatcctcgtgcaaacgcaatctggtagaagcaaattaaccgacattcgtcctcgtgacaaacgctatatggtagaagcaaattaaccattctagatacaataattttgatgatagtaatatgtgttgtgcgcttgtggtcagaacagctgcatcagtccatgagacctttataggaagaggcaaatcccacttatatataattacatcatggcagcttacatcactgcacttacatgaacatgttctactgtctgcgcttcagttttaaacactcttccctatccaaacaaagagcctaacaggaacatgcaactacatgttgagacgacaaacacttatattccgtccatgtgaagagctgaacacctccaaagccattatccttagttttgtaagccccctatggccctatagcagtagcagacacccttgctgtctttatgcaacaaagccacaacaatcacatatgctggatatctcatagaaggatcaatctgaaattcattctggaaacaggccatgcgctccatattttccttgataaattccaccaattatgtcaggatcatactacaaaaggacatgcagataggtcagcaaatgaaacaaagttacaaattaatggcaaccagtgaagatgtatcaaattatcttcggctaatcccatattgtagaaaaacaatattatcttcaggttgctagcagagaccatgcagggtatggtatcagcggaagcccggggaagactagtggaccgcggcgacggccttccaggatggaggcagacggcggctgtagcctcccaagattcacgatggacacgcctcccacatatggaggagaagggcagcggtggccgacggtgcctcctctcgctcggaggaagaatggaagaggattgcggcagatgggtaggttttgtgcatttttctttttcccatggatgaggagatgaatcatgaatgggccacgaatacgatgggctgtaacagcctggacgctgtgcaccaccacgtccctaggtggacgctatttacgagagcgtccacgcctggacactaagatggatagcgtccttcctatttttacaaatcgtgcccaagatttactagatatttaattcgtggattattaattattataaaaaaaattcagctttaaaactactttaagggcccctttaaatcgcagggttgaaaaaatggagagatagaaaaaacacaggattctgacaggaattgaagcgtaaaatagaggattacaaaacacatgaaaaacataggaatggttgtttgattgttgcgcaggaaaaacgtaggaatcagatgaaaaagatagactcagggaaaattttccaagaggttgaagcttttgctataggaatttcataggaaattttctccaaaatccatatgcaatgtgtcattctataggaatttcataggatttaaaaagcttcaatcatttaaatcaaaaggccaaataggaaaattttctatactatttgaatcctataaaattcctatataaatcctttgattcaaatgggccctaaatcttccaaggaaaccttatcttccccgaataggattctaattccttatattccgagaagataatttccatctttatttgtcatattaccttaatcaaaagaaatcttcgcgtatataatcaagtgtatttcatgaatccgtgtataggaggtatgcattatccttaacactaacacctactccctccggttccataattcttaatgttttgaacaatgacacggccttcaaaatatatctttgactttgtttttctactgtaatatattcaataaataaatgcatgtttacttttcttacagtactttaaaagataaatctatatatatatatatatatatatatatatatatatatattgttattgatgatcaaagttataaaaatttgacctctaccttttctagacttcaagaattatggaaccggagggagtacgtccctaagataacttagtcggtatatcccatcgatacagatgcggtagaatttttttattacatggatgtagacacataacaatcaaatatgctcatgaactcattcataacacaccctcaaagaggcaaagatcaacaataaatctctgacctccctgaatttctatctgtagtgcaaccatttgtgtttagtatttgtgggtatctggatttgaatcctggtaggttgaatcgtggttgttcatgcacccgcaactccactacttgtattagaaaatcatattaatttatattttaagtttgaaataattaacttaattaatcatacactaatagtttatcttgttttatgtataattttaatccctctcaaatatacggtgaaaaattggattgtggtggtgtggcaatgatgtatagcaagaagaataaataagcaatcaagtgaactagctgggtggcccgcgcaattgcgcggctagcacctaaacaaaatcatttttttattatgattttacttaaaatttattaaatagctatctcattgtcttaagagtttgaaagaccaaatcttatcatccacgtgttcctaattatatatatagttttttaaaagtcacaccagttgctacctcttatgtcatttccttttttatttgcttgctcgctctaccactatttttgttcattctccttggaacctttaagaattagatcttatagtttttagagtttattgtcacgttgggtttcgtttttataatttctagacgtcccgtcaaacgttgccattatactcctctgtatcccgtccactgtctcttctctttattgttattaagattttaaaaattaaatataattatcatttgggttcatttttactttctagaagtcccgtcactgtcagcggctttgccattgtacttctctacggctcgcccgctgcctcccttctttattgacattgagattttaaaatcgaacatgattatcattattttttttacttttgaaagttccgaacatttaaaaattgaaccttgtagtttttagagtttattgtcttgtttggtttcattttttataatttttagaagtctcgtcaaacgatgccactatactcatgtgcggcccgtccgccgcctactcttttattgtcattgtggttttaaaaatagaacataactatcgttggaattcattttttttattttctagaagtcctgtcaaaccgtcggctctgcaactgtactcctatacaccccgtctactgcttctattttttattgtcattgagattttaaaaatcgactatgattatcaatggggtttattttttttactttttagaagtcccgacaatcgccttgctcgtttgcttcacagcctgttgtcgtccctccttttaattgtcattaggattctatttggtgttttattaacattttttatatgtcgtatcaaccgccatcactctacttctttataggcatgttacttaatttatctcgtcatatgttttagatggtattttctttcaatagtctttatttttatcacaaattttagttatttataaattgtattcctaatttaaatcttatttttctttttctaatttcatattttctttttcaaatttcaattaatatcgtattgtgttcttttaatatttttattttttattttcagtttcagttgtttcaaaattgtattcctacttgaactctcttttaatttttctaattttggttattattttattttttattctgaattttaattaatctcgtattgtgttcttatatggattcttctttcaatattgcttatttttaattccgatttttagctaattttaaattgtattcttacttgaactattcttttttgttttgctatttcggattttatttttatttttattcccaattttaattaatctcgtactgggttcttatatggactcttcttttaatattccttatttcaattcagaatttcagctattttaaaattatattcctacttggactctccttttcttttctaattttggattttattttatttttatttagaattttgattgatctcgtattgggtttttatatggaaacttctatcaatattgcttatttttaattccgaatttcagctatttttagattgtatttctacttggactcttctcttcttctttttttctaatttaggattttattttatttttatttcgaattttgattaatcttgtattggattcttatatgtaaacttatttcaatatagattatttttaattccgaaatttcagctatttttagattgtatttctacttagactctcattttcttttttttctttttctctgattaatgtgggaatttttagcccccacagcgaatatggtgccttcttttcgagctaatataatagatagatacgaggggggcggtcaaatagggcggagagagaagatgggttgatgataataattgggcaactctcgtcgtcgtccggtagggagtaaattattaggggagagggagactggactgtttgcaataaagcaatgctagtagtagtagtagtatattaataccgaaaccaaaaccgcagtaggggggaggggagagagcagcttgccgtcatgccatgtgatacatgataggagtagaaggagaagaggagagagagtgtgtgtgaatcagtgaattaaggtggtataagtagcaagcgccaccggggagagttccttgcttggtttggttcctctctgcttctctctcttttcctccctccggcgaccaccagcataccataccatcgccggcttgcttgcttccttccttccttccttgggggagagagagagtgtgtgtgtgatggggacggggtggcggagggcactgtgcacgtcggtccggcgagatccggagcaacaagaggtgaagaggcgaggagaggccccaagcccccggtgtggaggaggcagcaggctgggtggcttcttctccgccatctccagcagccatagcagcagtaatccagcaacaacgacgcccaccctgcgatgccgcaccaaaccaaagccacagtccagcagcagcgaccaccagcagcagcttccgtcgtccgcgccggcgcccaagaagaggatgcctctgctgcaggctctctccgtgccatcctcgcccagatccccctccagattcgccctcctcaaggcctccatcctgcccaacaaggtaggtacctcttcttctccttctttagaaatgatgatgactcaaatgaagaataaatagctcctgcctgccttggccctgtgatcccccatgcatatcatatatattatgctcttcttcctcttctaatctggctgtagcggcggacggacggagatggagatcgaatcgatcaatcattgccaccactctctcttttgtcctaatccccttcccttccctcccctccttgagattcgattcgattcgcctcacgcaataataataataattactccctccgttttaaaatatttgacacagttgactttttagcatatatttgatcgtttgtcttattcaaaaacttttgtgaaatatgtaaaattatatgcctatataaaaatatatttaacaatgaatcaaatgatagaaaaataattgataactacttaaatttttaaacatgtgctaaaaattcaacggcaggtagtaaaatggaggtagtaactaataataacatcacaggcagaggagcagctttccttccgtcctgcaactgcaatcccccaccccgccacttcctcttttctttttgtttctttttaaatttctttcttctgggaatgggagtgacaatgcgagtgagaagcagaatggaacccatgaaattaacggtgaaggtataattgcagatataggtaggtagagatagatcgagaggatggatgatctcgaacaagatgtaaaaggatgatgatgcagggcccaaaggaagagagaaaggctgctcctctcttttggagtatgtcaaacaacaagtgaaaggctggctggggattggggaaagatggatcagattcagatcagatcgcccagctttttcttgattttgatcctccatcgattaccaatcaatcaaatgcctgccaaaaagaaagatcctccagcctttctttctttcttaattttgctccatccacagcactccactcactgtcgactctgtttatttagtttagggattagggattattactagtcttgttgtacttgttgattttgttgagagaaaagaaaagaaggaattgattgctaaagaaataaataatgttggatggatgcagagccggtgcggcgtgtgctcccacggcgtgaagaccggcgcggcggcggtgttcacggcggagtgctcccactccttccacttcccctgcatcgccgcccacgcccacgccctcgccgccgccaccgctctctcctgccccgtctgcgccgcgccatggcgccaggcccccttcatcaacaagcgcaccaccaccaccgacgaccacaagcgcaagtcctacgacgacgacgagcccctcctcgcgcccaaggccgccgccggcgccttcaaccctatccccgaggacgacgaggacgacgccaccgagttcaggggcttcttcccggcgcgccccaggagcgggctggccgtcaccctcgccccggacgccgccctcgtgtccgctgggcggaggcacggcaagtacgtggtggccgtgagggtgaaggcgcccgccctgcgctcctcgccctccacgcgcgcccccatcgacctcgtcaccgtcctcgacgtcagccagggcatgatgggcgacaagcttcacatgctcaagagaggcatgcgcctcgtcatcgcctctctcggccccgccgaccgcctcgccatcgtcgcctctccggcgccgccaagcgcctcctccc

SEQ ID NO: 69595 - DNA, 27315 bp, Oryza sativa
tcctgcagcccggacgtcgagatccccatcgggccaggggaggagccggcccggtcggcgctggtggcggaggaggacgacgaccagttctcggagcacgccttcgcgaaatgcctgggcggcctcgtcagcgtggtgatgcaggaggtgcagctggagctggcgttcccgacgggcgagatcacggcggtgtactcgtgcggccacgggcagcaggcggtggcccttgggggcggtggcggcggcgcggcggtgagtgtctccctgggcgagatgtacgcggaggaagagcgggagctgctggtggagctgcgcgcgccgctgagccagagccacccacactcgctgtccgtgcggtgcagctaccgtgagccggcgtcgcaggagacggtgcgcggcgcggagcagcagctggtggtgccggccctccacggcgggagctcgtcgcggcggctgcacgacctgttcgtggcgacacgggcggtggccgagtcgcggcggctggcggagctgaacgactacgcgacggccatccacctgctgtcgtcggcgcgggcggtggtggtgcagtcggcggagcaggggctggttggcagcctggacacggagctgagcgacatgcggtggcggcgcgggcagtcggcaggcaggcggcgtggcggcgagtcggaggagactccggtggggacgccgcgggcgcgggggggagagccgctgacgccgacgtcggcgtggcgcgcggcggagcagctggccaaggtggccatcatgcgcaagtccatgaaccgtgtcagcgatctccacggtttcgagaacgccagattctgattctcatcatctatcaatctcagctcagcttgtaatcaatgataattttcttttctttttcattttcattttcattttcttcttatgtgaaatgaatcaacaaacacaagatatgtctccacgacgaagaagaaagaagaaaggcagaattaagaagagggaggagtccctgccggagcgcggcggacgtaaattacatctactccctccattactgttttctttttctcttctctttttgtactcctattcaaaaatttgaactagtttagacagtctcatcctctctaactgtcactttgccactcattctcgcttctcgtctcccaagtatcaaatcgttcgttatctaacaacagtatcttttgcataccaactaataaattttaccaaaatatgtaaaaaaaagatcgtacatgcacttccaattacacttatgtgtaaaatattaatctaaaattcactatattttagtcgtaacaaaaaaaattaaaatccctaatagttttaagaatataaatctgttagaattttgactctttttctctatgtatagaatgaatttgaagataaaatattacacataaatgcgatactactaaaagtacttatatattttttttcttcaatttttgatgaagtttgtttgttggtgtgcatgtatgtacacatacatcggatacattcccatctaacaaacgaacttatctttcattatctatagaaaccaaaaatcaaatcttttattatctaaaacgcgaaaaccaaaccattcgttatctaaaaaccaaaaagaaaatatttctttctttatttccatttttcagttactacgtactccctccgaccgaaagttttttttacattaatatggacactaaatccaaaaagttctttaaacatatattcgcgtaaaaaagtagatttattttagtgcagatgggggtagtatttagagtttggaatggattaagatgatgcaaattgcaagatgatggcatgcatgtgaggtggttaaggttttaaatcaatcacagacaagagggacagctccttcactgcttggtgctcatcattcagtccatgatcctccgctgctgttgtgttgtaggctagtgagtgccttggtttgatggaatctttgtgcatgacatggccatgggattgggagggagaaaccaaaccagttaatctgatcctgactgacctgacctgaccatactacctgagatgaagagtgggtgattaaaacgacattggagattatgatgattcatgcatcttcttcttcttccttttcatagccaagctgattgatgcaatgttcttcttgataagggcggttttggtgtggactggactagtgctagagcttacattggagggagagaatatgggagcagtagactgattgcttccatgtccattccttcaccacaaacaaacaagcaaattaacaaacagtgtgctcatgctcatgctcatcattcttcacctcttgtttgtgttctctgtgcttagcatagcagattagcagtccagccagcagtagtgtcgatttgggcgcaacacaacaacaattccgacgctttgtttggccgcttgcgcttgcctccatcgcactctctgcaatatcaggcatgatgagctagccgctgattgctgtagaatgtgcccacatctgcagcactgttgcagggatggacggctcagctggtacgttgtctacagtgtataccgtatcctctccactgtctctgcatacacacaacgatactgctctactgtgtactactagtaactgctatctctctctttcgtctttcagcaactgtctgtattcttcttcattcatcaaaggagctgaacgtggcatatactcgtatgatatatagtacatacgtgagatcagatcttatgggaccgttttcaaaaaaaaaaaaaatcttatggggccaatgcaagcaacatgcttgctctctagctagagttcccttctctctttttttatgccttctcctcctgtttgcctgattattctgtgtgtgtgtgtgagtgtgttcgttcggcccactcaatcacttgcttacacatgatgcaatcatttagtattcatttccactagggtttatcaataaaatactaccaaaattaagctagcatttcttgcctccttcactgtttctgaaaccttctaggcttcactgttactgtcagataatagtagtatcattgatcaaacttataagtgtgtataaataaaattattgtgtataaatgtaaaagtctgcctttttctctcttgggtgcagtacataaaacatgcatgctgatatgcaatttacaagaaggtttctgtttatgttttcttgagcctcccctagctagctacttgtacaaaaggttgtaagctggtatgtcacggattccattgacgtcctccagagatagctctctctccagctgctgctttgttgcttccagcacgtcctggaatttgccattttgattaatttgatcatcagttaactaattagattttcactactccaaatccaaatctacggttagttactccctccgtttcgaaatattcgacaccgttgactttttagcacatgtttgaccgtttgtcttattgaaaaacttttgtgagatatgtaaaattatatgtctatataaaaatatatttaacaatgaatcaaatgataggaaaagaattaataattacttaaattttttgaataagacgaacggtcaaacatgtaataaaaagttaacggcgtcaaacattttgaaactgagggagtactttctaggatgaagaaaagaaggaaacgtactttgaactgcatgtaggatgctcgcattgccagccactgggcatccatcatctcgaaagctatacagtacaggacgtcaaatgcctcttcgtgttctaccattaccatgcagtgaattagtagtatttcattgtaaattatacttcagaaaggcactgcccatgcatgcatgattcatgggagaagatgacaagatactaataataagcgatcatttgctcacctgacagcactttgataaagttaatccctggcaaagacttgggccgttctgagcagagcagcaaccaaattaattagctactaaaatcaatgaagaagtaaaagggcaaacagaaaacaaaacaaaacaaaaataaagggcacatcaatcatacctcgtggcattatatacactacatgccatctgaagaaagaaaagaaaacagttgaactagctactagtcctagcaagcaattatagaagcagcccggccagcagcgacaattcagtaactgcatctctaaccagttgcactcaaggagcacatgagcaataagagcctttcttgtgtcaaagcatatataataatttttcttcctgataattgttagtagttcgttcttggagttggctcaatgattaattctggctagatgattgtgtgtacaatatttatacaggtaatgataaatcaaatagcaggggcagagagggaacacacaatgagacgtactgttgggcatctgaatcagttagcagttagccatatatatatatactatcttcttttcgaataaatttttgcataacgtttgaccattcatcttattcaaaatttagtataaatgtataaaactatatgttaagattatattttatttaatgataaaacaagctagtcacaacaaaacaaatgatattataaattttaaataagacgaatgataaaattttatataaaaagttaacggtctcatcttttttttaaaaaggggtatatagtactactcattatgcaccatctgtctgtctatatgcatatgatatggtcattatcaaaccaaaccgcaagattcctctaattgtgcagactgcatgcacaagagaataaataaacacagaagatgccttgttgatgccagtacgtaccggaccattctaatatgtgcttaattagtactactacgtagttagttgtttgacttgtacggctgggcacatgcagtgtagatgtactcttctgaccaataccgatgcagtgcaatgtacatagtcaatgatgcacaggccatgctgatcagctgagtagtgattcttacgacagattattaatttagttatcaatcagttgcacatctacagatgccatgcacatgctggccccttcttaattaattgatctcttctgatttcatgttttgtttttgtcatgctttcttttgtgtgcaaacgtaaatgcaaacacaaacacaaattatgcatgtatatatatgctgcttcaattcgatcttgtgcatgatgtttttttttggtcatagatatagatacaaatgtatatacctacctgcgttgagctccagcagctggatcaacatgtatgagacgttaacaccagcaactgcaaaggggtactcccatgtggctctcatcccttgtttcttcagaagcagcctctggtaagaagcctatcatgcatgagtgcagtaatgtctgtcaggctcagctaaattgttgttactgacagacattgaaacagcatcaacataccgtaccggatatgttgttgcaaagaagagaagattctcaagtcccacaaatccacagcccctgaagatcaagagtaccggatatgttaattacgttgtttatttctagacaaaccaattagctacagtcaccagttagtataatgtagagttagagattaaaaaatatttatgtacctgaaatcagtcgatgggtttgggccctgccatcccatgtccttccactgctctgaaattaagcttgacagctctgcatccggaaatgaagcactccacagagccctgagagcttcctacaacaaattactatctacattactggtacatttctatttaaccttgctgatatttatatatatttgctggaatttcccacctgatgatctctccgagtttgatcataaggtatatttagtctttccttcagcttttgcaaacgttgctcctgatgagtgatgagtggcattgaacaaggttaattaattagttcagacttgagatgtgagaaatgctatgtcttgatgaatgctgttataaaagaagagaccatccaaatccagtctcgcttgcaaagttggctgggcagagttatcactatttactgcatttgatggtttagttgaatactactaagaacgagccatcagaaatgcaatgtgactatttccattatcgaaaaaagaaagataacgtggcttggtgtatgctaatcctaatacaacttcacctgaacagggctcagctcaaaggtcttctcagcattgatttggcgccttctacctgagctggtgaaaaggcccccaaaccatatcctattcccaaccatagcatcaactgcaatcaggatatttgcaaaacaagagtcaagcatagagcatgtctttgaacaatatgaaattatatatgtccagacgatgacatgaaaattatcctacatataatttgagaaatcattcccaaagctagaagaaagttttgtgcaaaacaagcagagcattaagggatatacgaaaatttgtttttttagtagagtaatattgaagtagtgtaaaattctgataacctcagtggtatgcgctttcgataatgaattactgtgtttcgtaaacatgttagaatataaatttatataaaattatgagctttgaatttgaaattcaaagccatgcatgtgtttcagcacaaaaaaaaggctaggcaactgtttgtggtaatattgaatttttgtctagttttatgtgataatgttgacgccaaaacaagataatggcaaagaaaagatggaatgatgatagttgaattggatgaacgcatacaaatatacctgtaggggttggagctgaaagggatgaatgcccatcaaagaagacgaatcaaaagccgtctagcacggcaaaataagcatacatacatgcatgcctgttgttatttcgtcttgttttgacatgcatacacgtaagtaggctaactgcagcaagcaaatcaatcaataggcttatgtatgtaatatttgaatttgattgatgttcttagctagctgcaacaattaagatacatacatacatacaagagaggagatggagatggaggggggagagagagagggaccggaggagaaggaagagaggaagatagagaggatggagaattggaaacggtttccaatccaacagcctcagcctcttcaattcttcccttcttcctgcccctccccttgcctgcctgcctgcctgcttgcctctacaacaccaataacgctgtgtttcttcacaaaaacgacagctgtgtgcatgcacgctccatatatttcctctctccgatcatccctccccaccattcgtacgttttattcattcattcttcccagaccagagcggggcaattgcaaattaaggacctatctatgtatatgggtgggactcacattgggccggccttgtagcaatcattcatgcaggcccaaatcaacaaggaaaaagtacaccgaaggtccctcaacttgtcatcgagttacaaaatcgtcccccaaccgcaaaaccaaataccgaacgtctctcaactaatcataaccgggcacaatagatccttcggtggttttgacccctattttatcctacgtgacggcggagttagcgtgggacccgcatgggccccacatgtcaggctgagtcatctcttcctctcttctcttcctcggtttcttctctctctctctctgcatgtaggcggtaggccggtcggcggggcgaggcaggagaggaggagggcggcgcggcagccgcgaggtagagaagcgaggcggcggcgaagaagacgtgtaagccgcggcgacggtggtggcagagcaggacgcgatagcaacactcgacctggttttgctctcgggcctcgcgaaggcgaagaagcctcctcgaccttgacgctcgtcgttgtcacgcccagaaatttaacccaaatttccagactattttgtgtattaaatccctgtccaggaccagccagggtacacacaaaacgacaagtaatatacagttccaaacgtaaataaagcgtaacatacttacagaagaggcacttagtcctcacaaagaaagagaacgacagcagcggaaaaaggccatcctagcagtgctttagcttcactccacaggcaaaactcaactggggtctaagccttggtcttctaacttcgtcttcagctcagaagcactacacttctgaaaagagggaataatagcaaggctgagtataaccaccgtactcagcaagccacaccaatgatgcaaacgtgcaaggggaatacaaggacggcttgtggctatttgcataaaggcggttgtaaaacattttattgagcaaaaaagtaaaaatgctgagtaattaaagtaacattaaatctccactgatcaacgctacaccatgttgaacaggcccaaccaacccacctgaactacagtgcattgagtcgatttattaaggtgggactgatcacggtgaatctggtcgaccgcccataaccgcgggcacggctattcgaatagttttactctgatcagaggtgtacaactgtaaccacaagacaaagccccacaacacgtttccatgcgccgacatgccaccacgacataccggaaagaggccgtgacatgacccttcgcataaccccctctagccaagcacaccacacctcaggtttcacccccgtccccagcgggcaacgggcagtcccctctcatgcctaggtgaatccggaagcgacagaggccgtcgcagggcccgccctgctccatcacgcccacccttgcttgggagcgtcggctagagaaaagctacactacaaacccagccgttgcccacgctggcttgtgataagtacaaggaattcttccagggtttcccgcgaaccggtccttaattgtcatgggtgcgactagcaaaaccatgcacccacagctcaccattcagtcgcattttagttggataattacgaccatgaagcatggcaagatgtctcgagcacgcagcttgtcatgtcactaagaggtctaatactgcaattatcccatcaactgagctagtggtaattaagcatggctaagcatatagttctagctaggtcacataagtaacatgagctagtcgatttattacccaaggttgacaaaggacagatatcaagtaaacatggcacaagcgagcagctaggtaaacccgattcccatgtaattggcaaaacatgcatatttatttgcaaacagtaaaacatttgtaaagtaggctcaacatgctcaaggggaatgtgtgacttgccttgcttcttcactttgatcttctgaactcttttcttcgcgacagcggacttccgaaacgacggattctacacgctggcacacaaaacgaggaaaaactctaataaacaccaagcaaacagtacataaaaagtaaacaaacatgtagatcttaattttagatgaattttgcaagttgaacggcccaatttggagttcaaatgaattagttatgaattttagaaagttttgagccattaaatgaacttctataattattaatgatttattacgcaattgataattactttccaaaggaaaaggcacagccgctgacgtcatcaagtgaggccggcgccgacaggcgggccccacacgtcagcgagacaaggaggtcggtccaccgtggaccgggaccacaagggcggtccaccgccggtccacacggaccgacggcccagatcagcccgagctgatcgggcggccacgggatggcgcggctgggcacgggcacggctcaggccggcccggccgagcgacggcgcgcggcggcgcggtcaccggcggcgacaatcggcgatggcgcacgcgggcgatggcagcacatgcaaagagagcggaggcgcggcgcgacgcggcaggggagcggcggcgcacgcgggcggcggcggcgcgcacggccggcgaagaggagggggaggaatgagggcttctcacccgggtggcggccggagcggaggaaggcgacgacgacagcgatggtccggcgacgttccgcgagcgggaaacggcggccgatggtcggagggaccgagggaaggaaatggagaggttaatagagggtaggaagttgcggtgcgcgggaaacgccggacaaaatgacgacggagctcaccgggaggcacgggaagatgagtccggcgacgactggcgaacacggagggattgccgagccacggacgacggctgcggtaccggggagggcgacggcacagcacggggcggactgaagaggcggcgcggcgcgtccggaggcggaaatggcgacggtagctctggttggtagtggggagggcggctcggtggtggattggaggaacgaggaggtggccggtgctcggcttggagaggtgaagccgacagtggcggtggcgcggcttggcggtggctagcgtggcgaggagcggcggccggagttcggcggcaagcggcggagagaggttacacggtgggcaggtggttccgatggcggttgaaggaaaccgggtggaggccggcgtgcgacgcgggacggcgaagctgatggcacacgcggtgaggcgcggcgacggcggtagcagcggcggcgcgcggctggagatcgccggcgggagagggcgcggggagctcgggaatttggggaaaatgggagagggggccccggggatgctttttataggtcccggaggtggagatcgtggtcgtggcgggcggcaacggccggcggagggagctcgtgcgacgtgggcgagtggggcttgaacggcgccgatttttgggggaaaatgggggagaaagtggaggaaggggaggacgtggggtggaccacgtccacacgcgcatgggagcgtggaggcgcgcggaggaggcggcgtcgtggggtggtttcggcggccatggaggccggccgaaggttggggacggtcctgacatgtggggcctcgggtcccacatgtcggccggagagagagagggagccgagggagggtgttatgtggacttaaggagaggagagccgggctgggccggaggggaaagaaggagggagggggattgggccgagggcggcccaaaaggaaggagagggaattttatttgttttcctttttatttaattggttagatgaactttgtgacattaaaattatttattgagctccgaaaatttacgggaaatttcagagagtactttagggcacagagaatattgcaaaatatttccagccaatgatttttaagggaaaattgtaattctcctataatttcacttgattggattgatttaacttttatttaatttttagaaaatgcattattaattgatttttaatcccaaacgaaaatcggggcgttacagtcgtgaagacgacgtgcttcaggtgcgccctgttgttggatgcgtccaccggagtgatgatcgtcgtctcgatcgtgccaccgccacgtcacacgcaggagctcgccgcacggtgtgactgcgaggtactgtgtgggtttgggatcagaggagtgactgcaaggaccaaggctcagaccccagttgagttttgcttgtggagtggagctgaagtcccgctaggtatcgccttttcgctgctgtcgttctctttcggtgtgaggactaagtgcctcttctgaagtattttacgctttatttatgtttggaactgtatattacttgtcgttttgtgtaccctgactggtcttggacagggatctaatacacaaaatagtctagaaatttgaggctaaatttctgggcgtgacatcgacccacctcactgccgcgacatcaacgaccaaagtgcgggttcggctgtgggggcagcgacgagggtcaggagtggctatttgggggcgagaggtggcggggttcgggggtggcagtggtggcagttgggggcgaccgcggtggctgcgagtgccggtgcagcgcaggtggtggtggagtcgggggtggcagttgggggcagccacggtggctacgagcgccggtgcagcacaggtggtggtggggagcagcggcgcagctgccgagacaggtgcggtggaggaatgaggagaggcggcacgacagccggcagagcggtggtgggcagcaccagcatcgccgcttcaccccttctcctcttgccttcgtcatctatctcgccaattctagtctcctctctcgcatgtgcgattcaacatgttgacccaggggtagaaacgtccgagaaaaagtgtaattaaggaaaagttatttctagatgcaagaaaccaagaaaatagcattccaacgaacacccacggcttgggagcggtattcatgcgaagcccattttagtgaaggtattctaacgaaactacttttttgcgatggtagatatgcaattttctcagagagaaaattgattttatttggagctagtgctttgtgttggttaacctggcgttgccataatgatgtagtttttaacctaaaaaaatacccaacatcatacagattatcttcatgtgttccaactagctccattcttagtgtatgatgttttcacaggaacaacaggatactatacgcaacggagctacacgcttggaattggtagccaagaaatttttattccagtttggatatcgtagacataattttttttatagaatctatgtgattttgaaaatattattttagtagatcatcttattggtagaagtttggtgtttgtcccatcacgtctttttttaatttcttttatgtttacttatgagactttttggttatgtgcccatggacaaaggtcggagatgtaatccatttctattatctaataaaattaaaaaagtggttgtccaaggtttacaataaatccactctaacaaaattaaattgaaggtttaaagaatttttaatgcaattattttcttttaaaaaataatagtgcgtatcacaacaaaaggaaaaccaactattatcattggaacaaattaatttaggtttatgtcatgcccacgccatcgtgacactttactgcatgcttcatcttattcggaaaaaaagctgcatgcttgcaaacatgcatcgatctccaccaaacaccggaaaggatagtcgatcccgaccttgatatatgcaaagctgatggggaacgtacgaaagagctatagtacctagctatcttcttgcttgaaatgtcgcatcatgatgcagcagcactttggtgcaccaactcccctccttcagattcacacgcgcgtacgctagctagctcttattggaggagtttcaaatttgttggaataaatgagctggccacaatttactctcaattaatttcataggtccacaattaatactatagagattaatatcaccataaaaatttaagtggagatatatcaacttaaatagagagctatattagagagtccctgttaaccgattaaggtggtgatgggacagccacacatgcgcattgttgggccaggccagatgggccgttactacgtgaacattgatgcttattttataaaaagcatgctcatgttgctcatgtttagcatcatcactagatcaattctcattgcaaatgtcatgtttattatattctggattaaaatataccgaattatgatcatattttttttaaaaattacattaattatttcttatagagattgtttagaggaacttccatatggaatttcccagtggcatgcatggctaatatatagtgtgtatgatccaacatactactatatatagctgtaagtgacgcaataatctgatgaaatattgtaatgtattaatgatatgcatgattagtgcaaaatttgaaattgagtgatcttttgtcactaaaattagatgcacatgcaatctactccctccgttttacaatgtaagactttctagcattgctcatattcatatagatgtttgtgtacaatgctagaaagttttacattatgaaacggaggaaatataatttaacaaatgtttttccactgcatgtattatgttcacaaattagagccgtggcatatatatagttcacggtgcatgaggattacaacgtgtcacatacggctatatatacgtaataaatcaaggtagtaaggccttgtttacttcctaaaaacttttcctaaaaacattatatcgaatctttggacatatatatggagcattaaatataaataaaaagaaaaaactaattgcaaactagcatgtaaatcgcgagacgagtgttttgagtctaattagtccatgattggctaaaagtgctacagtaacccgcatgtgctaatgatggcttaattaggctcggaagattcatctcgcggtttccaggcgagttatgaaattattttttttattcgtctctgaaaaccccttccaacatttaatcaaatgctcgatgtaacatttaaaaattttcatttcaccaactaaacaagcactaacttgttaagttttcttcccaaaaagtttcttattcgcttgcatgtactcgcttggttctaaccctagaaggctggaatttgttggtgttgccttggctcgcgcaccaaacgtcgtacgtggtgtcacccacgcgtcatttttccgtgcccgcgcgcacacggaaatatcaatattttatatatatatatatatatagggggtcatcagttgaataaaaatggtgcaccatttttaagtgtatcggagttggtcaacacaaacgtagacgtagatgagcacagcaaaaatgttgaccactagtatgggtgggcgtggttagagtgaaataattttgatttgaagttgatttaatgtgaccagcagtaccaaatctcttacactataggacaaatttagaagggattaagggtctgtttggattccaccttaaaattttacatcctatcacatcgaacgtttgaacacctgcattaattattaaatataggctaaaaaataactaattgcacagattacgaccactttgcgagaagaatcttttaagccttgctccatggtttgacaatgtggtgctacagtaaatgtgctaatgacggattaattagacttaataaattcatctcacggtttactgacagatactgtaattaggttttttattagtgcctgaacaccccctacgacactctatataatacttgatgtgacacgtcaaaactttacaccctgaatctaacaccccctgaaaataagagatatatatgatgggatttgatctcgctgatctagaaggagctactactaccatcagatatattctcttccgcatggaaaaagtgctaatacatggaaacacctggcaaaatatcaagtaaagtaactgattttgtaagcaagctatcacatggaaagaaaatcagtagcataacttacgttcaatttcttgggtattaaatggaaaccaatctacacgaatatcttaacgagtttgacccgtaattttcaccaaatacccatttgagtgcagcacgaatcctaaagccagtgaacggtggatagtattggagcccggacaccatagagcatcaaatatatatatatatatatatgtgtgtgcgcgcgcgcgcgcgctaccagccgcagcagatgcactgatcaagcattaattctagcgagtcatccacgcaatcacagtgtatgtatacataaattttgataatttgattctttgcaaaaactaatttcacaaatgaatcgtggttaaaacttattttaaaaatgactcttttgttcagcgccgaacttagacacttcagcgttaaatagcacggcgctaaatgcacgttggcacgccgactcaacctcccatccgtggtggcacgacattcagtgccagttgacgtggcgctgaggtgtcatagttcagcgccatacgatttgtcgctgaaagaaagggttatttctgaaataagttttggccgcggtttatttgtaaaattagtttttgcaaagtgtcaaattgttaaagtttgtatgcacagatcaatgtgatatcattaggattgccttttcgatgtcgcaaaaaattcaaaattaatttaaatatgattaaattctatgtgttggaaatactaatatttatattattgtgatattaaactagacataaaatatggattataaaatgcaatagaggagaaaaagaaataggggctaagaaataaaggttgttgcttgagttagaacctttctagagtcccgaggaaataggggtagcccccatttaacctttagggattcttaggccctgtttgaatcttcaataaaagttggataaacttttggataaaagtgacacgcttttcaaactgctaaacggagcgtttcgtacgaaaactttccatatgaaagttgttctaaattttttaaaaatctatttttcaagtttgtaataatttcaactcaattaatcacacgttattaccacctcgttttgcgtaaaacacttaatctttatcttcaggagattcaaacaccacctaaaataggagatattgctgaagatgcttagtgaatctaaaataggagctattgctggagatgctcttactctttacttcttgagttaaaagaaatgtgttcatatcaatcaacttccaatttagtatcatctcaaaatagctacctagttgatttcttttaaaaaatacaccatctagcagtttaagaaatgtgcacgtgaaaaatgagggacatttctcccctttgccttgtctcaaacgtccacagccttatgttgtttatattttatacggaacacatatgctatattttgggacgaactacggctacctttcttttagtttcatattttcatatgggattcatctactatatgctacctccgtcttaaaatataaaatattttagagttgaatacggaaattaaaaagtaggtagaattaaatggaaaaagattgtgattagttgtgaaggaaaattagtactatgtgacaaatttgaaaggtgaaaggttgtgattggttgcgcaatgaatgtacgtagagaagttgttatagaatttagtaaaaaaaactgttattgttcttgaacgctaatatcaatattctaatttaatgctcaccctcacagtgaagatgatattgtatgaagggaactatacgtaaagaatgatgtttaatttaaaggaagcaaatagtttagatttataaatgtaaacttttaaaaagtataaaagtatacatatgtagatagatggcaattgaaaagtgacctcactataacatggtgcttcaccaactactccccatgtgtactgtctactctctcgtccaattcccgatgatatgtactagctctcagctcccggccactttcatttttttattacaaatagtatgtaccttttttgcggggacatatataattgtacttgtatagatcgatatcatttcacacaccggctaatgaatgcgaacctaacacataccaggagacggccagactagctagcaagcaagtcattaactaaattcttattgaaaaggtaaattcttatagaaaaacacttgcaaaagcctcatatatattggtgcgccaaaaaccattacacccttggtgcttacccctaaaccctaaacgtatcctctcttttgttatcatcacactggtggagaaatctttttactcctgatttataaccccctgtagtcctggttttccaactgggactacaaattcagggcagcggcagtcccggttagtttacttttttttctttcattgtttttattgctacttactacttaatccctaactgattttctcccgaatcgagtggggtgtatatccccgaatcaaaccccaaatcaaagtaatatcccaaataccataaatcaaatacatcacagattatacatctcagatccatacaataaatcacagattctaaaaaaaaagaaattatagatctcaatccatacaatgaatcacaaattcttcaacaaaaaagcacctgccgctgccatcccctccacgccgaccgccgccgcactcccatccgcctgccgctgccatcccctccacgccgaccgccgccgcgtggccctccgcaccaccgcactagccgtcgccgcggcggccgccgccgcgcggccctccgcgccgccgccagccgggctgccctcctcctgcgctcgctcagccgcgaactgtgaaggaaggaaagagataaggctgtaaactgtgaaggaaggaaagagataagttagagaggaaaattaagagagaggagtttgtgtggacgggagaagaggataagtactagggattatatagtgcgttttgatctttagtcccggttagtaacaccaaatgggattaaagtcctaactttagtcccggttaagccccggttggtattactaaacgggactaaagatcaccgggatctttagtcctggttgataaccgggactaacgatccgaactttagttccggttggagttaccaacagggactaaagattccggagggccttgacagcccctaacagcatgtgaactagtcccaggactaaagatcatatagtcccgttctgtttataaaccgggactaaaaatcatctttaatcttgatttttattacaatcaggactattgtgattttttaccgatcggacaaagatggtttctacagtagtgtccgccgatcaaagtatatatatgtaaaactctgtgatttccttccaacgaagaaaaaaaggaaaatcatttttataataaaatttctcccattagagatgaacggctacgtgtcattgcagtagagatgacaaggaaaatggtttgaaacctactccctccgttaaaaaaataccaacgagatgtgatccaatataggcagccctttatccaaattcatagtacgaggagaagattgtccttttcttttgagacgaagggagtagctaattcctgttcattattaattatatgttggaacgggaagatataatatgtaggtgcaatatattacttctggagattattaaattaggtgcaaatatgaggtccaaacgttcaacacggggtccatgtttgtttaatggaattaagtatagatgcaagtacaaccggtgaactggacacaaacttaaggctgcattcgggaggtgagttcccaaaacggagcgatccatgattaattaaatatttactattttttaaaaatagattaacatgatttttaaagcaactttcatataattttttttaaaaaagtaccgtttagcagattgaaaagcgtgtgcatggaacacgagaaagaagagttaggggaaagaaagttgggctgtatttagttcatgtgccaaattttttaaagtatacggacacacatttgaagtattaaacgtagattaataacaaaacaaattatagattccgcctgtaaactgcgagatgaatttattaagcctaattaatccgtcattagtaaatgtttactgtagcatcacattgtcaaatcatggcgtaattaggctcaaaagattcatctcgcgatttacatacaaactgtgcaattggtttttttcgttcatatttaatgctctatatgtgtccaaatatctgatgtgacggaaaaattgaatgtttgaagaaaaaattttgaaactaaacacggccttgatcaatagttttcgctcaatggtttgactggggcaggctatacattttccttcttctagaccgtccgtaaaagtggatgtgcgtgaaaatggtattttactattttttttattgtagaatttagaatctactgcgtaagatctcaatttgataattaaactatacagatagcaggcttaccagtaaaaatatcacacatagatagatatgactattttcataagcggtgctttttaagtgcatgaattgtgtaaatagtgagccctacgcacgaccgacgatgctcgaccaccgcccgaagcaaagtcaaagatatatcctctttgcatcctcttcatctccttccttcggagctctcccctctcagagtcctcgcaacaccgctgcctcctatttcccctctcaatcgcagcctccatgaaaccaagagtgtcgctgcctccatcacaatcgtacatcctatctgcgccaccctctccctcaccagtcagagctaggatgcaccaatgataggtggagtgactagcgtgacccaagatccggtgcgaggaggctgtcggcaaccacgcgagagtggtagagagggccgccgcacacctctcctcctcgagatgcgccacatatggatggcgaccagctggggagtagtgaggaggccggatcgggacagcggggtgacaacaatgactacaacgacggtggcttcactgatgaatttttgtgaatctgagttttgtggaaattattttgctggggagctagggtttgtggagaacttttttttgcaaaaatattttccaatctggtgcctttcgattttcacaggaggtctactaattgaaccgtgtatgataatcgattttcacatatataattgtgtggggctacctatgaaagtcccaaattttacagaaatttggttacagacagatgctccacctagtaatttgggccgtctgaaaaaacattcttggtaatatagtgattaattcattccaaaagacagtagcgacatctatttaaatatggagggaataattattatacttaaataaaaatagaagttgtataggtgtactattatctacgaaagctttcgctataacaaatttgaatgtgtcattttcatatgcccaaaatttaaataattattttcttaaaatataagtatttttagcttgaatgtacttgtccatatttcgaaattagaagttgttgtatattataatggtcaaaatgaattaagttaactgcacgaattctaaggtaaaacttatttgtaactagagagagcaggtaaatatgcttaaaaaatttacgtgaagataaaacacgatccatgcctcttcattagctaattcccctgtttcaaaatatagcaataatcttagaatcggacgagacattatgagtacggagatccaatggtaggttatcatcctgggacggagggaacggagggagtatatatatatgtctataatagtgcgtgcggtgaaacagatcagtaaggtaggatggcatcgttgatggaagtgcaggtgccgctgttgggaatgggcactacgatgggcgccctggctctggctctcgtcgtcgttgtggttgtgcacgttgccgtgaacgcctttgggcggcggcggcttcccccgagtccggcgagcctaccggtgatcgggcaccttcacctgctccggccgccggtgcaccgcaccttccacgagctggcggcgaggctgggccccctgatgcacgtccggctggggtcgacgcactgcgttgtggcgagctcggcggaggtggcggcggagctgatccgcagccacgaggcgaagatatcggagcggccgctgacggcggtggcccggcagttcgcgtacgagtcggcggggttcgcgttcgcgccctacagcccgcactggcgcttcatgaagcggctgtgcatgtcggagctgctgggcccgcgcacggtggagcagctgcgccccgtgcgccgagccgggctggtgtcgctgctgcgccacgtgttgtcgcagccggaggcggaggcggtggacctgacccgcgagctcatccgcatgtccaacacctccatcatccgcatggccgccagcacggtccccagcagcgtgacggaggaggcgcaggagctggtgaaggtggtggcggagctggtgggcgccttcaacgccgacgactacatcgccctgtgccgtggctgggacctgcagggcctcgggcgccgtgcggccgacgtgcacaagaggttcgacgcgctgctggaggagatgatcaggcacaaggaggaggctaggatgcggaagaagacagacacagacgtcggcagcaaggacctgcttgacatcctgctggacaaggcggaggacggcgcggcggaggtgaagctcaccagagacaacatcaaggccttcatcatcgtaagccagcacgcacttttttctttctttctttcttaattagctagtggagtggagtactaagatgatgcatggatatgatgcactcgatcgatcaggacgttgttactgccgggtccgacacttcggccgccatggtggagtggatggtggcggagctgatgaaccacccggaggccctgcgcaaggtgcgggaggagatcgaggcggtggtggggcgggacaggatcgccggcgagggggacctgccgagactgccgtatctgcaggcggcgtacaaggagacgctgcggttgaggccggcggcgccgatcgcgcacaggcagtcgacggaggagatccagatccgagggttcagggtgccggcgcagacggcggtgttcatcaacgtgtgggccatcgggcgagacccggcgtactgggaggagccgctggagttcaggccggagcggttcctcgccggcggcggcggcgagggcgtggagccgcgcgggcagcacttccagttcatgccgttcgggagcggccggcgcgggtgccccgggatggggcttgcgctgcagtcggtgccggcggtggtggcggcgctgctgcagtgcttcgattggcagtgcatggacaataagttgatagacatggaggaggcagacggcctggtttgcgctcggaagcatcgcctcctcctccacgcccacccgcgcctccaccctttcccgccgctcctctagctacccctacctacctaccactcctactcctttcctgtccctgtaacgcaccgtaatacaaccattataaattaattaccactttactatattgtaataattaatgtgtatgtattccctacctagacctattgcatgtctctcaaatcaaatattccaagcaagcttgattgtgatacagatgggacagatttcagagctactagcaaattagtatattgttgacagtcgtcacagcacgggcagattatattagtcaacgaaccacaggatacgctaccttccacagtactcctaattaaatgtaccacctatttagacatttggctcctaaattttgacaaattggctccgcatctccacaattttattggctgctaaggctgcgtacgttcaaggaacgttcatgtctagcacggtaaactgagcgacttattagcttgaaaattttaaaatagatgaatatgattttgtaaaacaacattcctataaaacattttacaaaacacaccatttagcaatccggaaaatatgtacatgaaaaataagaaaataaaggttgggaaaagaagagccaaacacaatcttagagtggatggttcgttttaacaacagagggagagattcaatgtgcacactttctatcttttttttatcttttttttagtgtgcacgttttttgaactgctttttttttaaaaaaatatttataagaaagttgcttcaaagattcatatcgattcatacttaattagtcatgcgctaatggcttacctttatatatcttgtccttctcttttacccccatctcaagtaatacaaccatacaaccttaggatgcattttgaccataccgacaaagttcctaggttgattgggtcgatgaacatgatacactatttatgtgaggtttctacaagacgaaaatgaaaatatctgataatcctggtttgagaaacgctaccatcaattctgtttttagtgactatattaacaaattgcctcaatgcatgggaaacaattctaaactctcgagggaacatttctcgttgtttgcatgtcactagcttaaatggttatgattttttttaaaaaaagtttcaacaagatagattaatatgtgatagaccactttgcaaatatgcaaaatcatatttaacttatacaagttgcaaaaaaaaacaaatttaactgtaaatatatgttaactagttatagtttaattttttctcaacttatagaagttgaatttgaacttacatgtttgtggggtgatctatcttctttattttttattttgatgacatgtaaaaaaaaaatcccctctagagtttaaaatcccatcccatcaatgtatagcatcttcaagtgtagtaggtcctactaccatcccagctcccttatcaatgtcagtttggatctcccatacatgatcccactccaccaacccctctccacccaaccaacccaagtccatgacatattgcagccacttctagtcggctacatcaccgttgtttggtgccatgtcaactcacctcaccatttgctttgctttatttttcttccttaatttgtttggagttcaattgttgtcctacaaattttagcaatatttcttttcccacttgactcctaggttatttatttgaggaaaaaaaatcaaaaatttaatgtgagcgttcatcttgcaaccgaagttattataaaccgaacattgagccccctaaacattctcgaaaggtccgagctaccccagaaaactgttgttgagtagatttgcctacacgctgcatcaagccattgacccaacggttttcctttctaacacactgacttaattatatattttgacacgctgaatgggaatggatcctgatgaaatcccatgggggcaaaaaaaatgctaatccaagtgtataatgatttggcatgactacaagacagcgtcggttgaaaatagtgtagacgctacaatctttgtttgtcaaatacaaggttgcggttctgtttttcagttattttgtttttcaagccaaagaccacggcttacagtgcggtaactgcacagtaaccacgagaaaattttgaattcaactttttaaatatgaaattcacgtggtttgtgataactaccgtacggaatgtggcctgtgggggtggccgcgggggcggacacatcctcgaactcacagatgcaaatgcaatgagagtaccatattttaggaaaccttctgcagcactacatgaattagcaaacagtgttgtgatgttcattgaccattgtgcaatcaaataaaaatttaaaataacacagcgagacagttaagtacagtcaacatacagatgcaacagtttgcttctatttggtctttatcccatcagtacctttagaaccaccatcatacgcagaaaggaagaacgaactctggttcttctgcagaaacctaccatgaattccaaattggtttagtaagcattttggctttaagtatgcctaactatcagggattgctacaatctggtaagcatgtaactaaaattatggtattgaccagaaaattgattgtgggacagattttcaagcatgtttctaaaagtcaggctaactagagagctgctagtatatacagaagaaaaataacggctggaatttcatgaagaaatgaaggtgctaaccgacttcacatatttgtgtatattgatgggaaatgaatatgttgccatagtgacgccaacaataaaatcaagaaatatttgcttacttgagaatgtccagcaatttctgctgtagtttgttgagtgcatcttcttccatgttaacagacgcaagtagctccggcaatttcactgcaaagcagcaagaagtgaaccctttcaaacattgtacttagccttccaaattattctgagtctcaacatcctaccgacagtccgacacaaaacattcatctcaaacaaaaccttgtatttcattcagctaatgggggttccaatttattcatacctgtgaacaattattacccaggctctagttcaaattataatagaatacacaagggttacaatagtcgatgttaccctcttcaactatagccctaacctaaaaatccaaccctcaactatgaaattggacattttcaagctcaactaccaaaaccagttacagctgacatggcaactatttctacattgcttgcaaataaggtgccatgttcagcaaaaagtagataatttggatgccaactctgcaaaaaccaccgtaaaaatcatattggactggtcttaaggggctcttttgattacgctgttttgtttcatagctgagaattgatttctagacaacataatagatgaggagggtaaaataaattttactcagtcataacaatgtattcaaaagtgaaactgatataattggtttcaacaagagaaggtttagaaatgcaatgaaagcttgaagaagtaaatttgcaagttacattcaggaagaaagtgaaattttgaacagacaataaaccttgttcctaattgtttccttactttactgaataatttattcattggtggatatctcatataatcgagaactgcacataccaaaaaggcgcagtagatgctcggctccatatataattgagggcgaaacatcacctttaacctcttcagtgtactgctgttgttctttcttatataaaagcattgcaggcaatgctttatcaaagtagcatcgcaatcctttcaaaatctcagcataagagtcatttatccttcagtacaaacaatacaaagttttagtgggtcttttcaagaaaaatatatattttttaaaaaaaatcttgacagacacagatgatgcaaataggttttggataagaataacataacatctaaacctttgttgcataaggacagaatttccataattatggttattaatatgaatattaaaatgattttataagttttgggtctcagacatttagatgtagtgaaatttaatcagaaagagttaaaggtcagtttatggttttgtggatatacaaagaaaaaacagcaaaccagcagtctgaccataggaaaccagaattggcaacctcaatggttctgtttgcttcatggactgctcatgcaattagacaggtaaaaacaggcaaatcagaaggttacatatgaaacctatgaaccatgaaaatcttgaaccatgcagccaatgtgcaacatgaaagatttgtccagggcatggaccaataaatgctggaactctccttgtgaaggcacacagtacaacagaaataatcccaccagtgaggccaaggcgctgaacaagaacagatgcatttcaatagctggtttgacttttggtgtatggttttcagtcatgttaagagaatagcatgcacatagtaaacatactattggattatgctgcacataataatcagtaaccaagcacacagaacacacaggatgaattacaaaccctaagctaagagtggaaattctgtggttgtgctgttgcaaaac

SEQ ID NO: 69596 - DNA, 14952 bp, Oryza sativa
aaattttgcgcaagtttttgcatattatgggtataacatgaagatatgaatcaacaatacatgtcattcccatgtccgatacatacaggatacagccatatgcagcattccagtgtatctggacatgtcattcaagtttagcatttaaaattaacaaaatgagatacagcagacccaccatctgcatcttatataaaaatccacgattagcccaatatcatattaaacccaaatccctctgtggagtatactagaaaacttgagaaaactaatgagcattctggaggaaatgcataatcagaaattcagaaaaccattttaaggtatcctagggtgaaacatattagttgaaaattgaagggaaatgcagcagatgtcacatggaacatgcaacttgggtgtgttcctcgttccggatcgaggaacgggaactatgtggaacttcatcccgaaaatggatggaacatggatggaacttcatctcgagagtggtcccagtacaaggtatgatagaataacgagtagagcagtatgatacagaaatgcagcacaatggagcaaatgatggaaaggcaatccaaaatttccaagcaaaatctataatttgattaactttcactaaatttgaactcatctggatgggacgaacgttgttgttgctccctcgctgctcgccaacgtcctgctgtgcatgtacgagcgtcagcaacatcatgcagtggagaatggacaagcattgccctcgtcacgctgtgggacgaccatggagtgatagagggatgttccaaacaacttaggaatgtgttccaactaacgttccatgttttaggaagaggtatacccctaacgttccatgtttttagaaaatggcatcccgtgttcctcgttctagttcctcaatccatcgatctgggaacttttgtgaccacggcaccaagacctgtccaaaggtgatagtccctatctttgttttacattatctttgtatatatgtgggaacctaccaaaattcatgaatattcatctgaatagccattttttttataaaattctataacacactacacaaaagtaactttgcctagtttgtcagtgagtaatcttaaactcagcgattctcatgcaccagcatcctcctgtttttttttctgtttatttgttaaaattagagtaacttccaatactttctgaaaaatacatcaattataattcaaaagcatgttagactataatatctttccacattttattttatcccttcttccaattaaaagacttgtaacttctttgcacctctgaaagtttactcgaatactcgttactcgttcctttattttccactcattctctcaatgacatgttggtccagggtccacatgtcagcaagacattaggggtaaagggatcacatggattttcaagtagcaaataaggaattgcaccaatgacactaacatttgtttaaaacatcatggtgtatgcctcgatacctacagtagaattccatatcccaacactgtttataacttgttgtgtcaaagatatgccaataaataagaatttatgtttatatagaatgcttacttgttatccttctttgttcggtgctccaagtacttctttagaatatcatcgacagtgggggatcgaggtagcttcacaagctgcagaacaaggaaattggctcaggaaagaagctggtgagaatgataaacagttaactttggcatactgataaagtgataactgaggacaaactcatcgtatttgtagttttataacaagtaccttttcctgtcaggaattagtgcaacataatgacttgaaacattcaagtctgtctagttgttagtaattcttcttgaaatagtaacctttttggggaaccttaattcttacaattttccatactacacaattcttacatgagaaatgaacatgacaacatgttggcatcagtcaatcatgttcaaaaaggtgcagaaaatccagctccacagatacacgaaatatacaaaatatacaggatatatctaggtaagtttgagtggcatatatcaaggttgtttgtctaacagtaaggtggtatatgtcaaaatttagctgcggaatgtacaatgaacaatatatccactggtcaagattgctagttttttttttctgaaggaaataaatattgctagttttcattctcttattagttcctatttgatacaaatatgcttctcttaagtacctgttgtttccatgccaattcagagacaatattcaattataattgaacaatgaggagtgtgctttggacataaataattcaaagacggctcagagaaagaattgaataccttacccagctgcgtgacaaactcccaatcatcaacaagttgtttttttagtgttgaaggaaaatgtgacatgaagagactctcagatgattttctttctttctcctggatcaaacagggcagagttgtcactatgtttacaaatatgtcacaagaaaacttgatagataaaatgttctaccatatgattgccaaatatagctgaaagcttcaaaatgtaaaatttatcagtctgcaaataggtaggtcacgaattctcttcgcacaatgtaaaacattagtttatagttccagtttaaatttaacatgtgttctaaatttatccatactacacaattcttacagttagattatttttgctggtaaccaaacatcatttagtccagaaattggattgttgtgtaaagaactaaacgaagcactgaagcaacatgatttcctattcatcattacaatttagaatgttgagaaaataaaattgtcatcatcatacaacaaaaggtccacgtcgaccatagaatgttcccattttccacatgtatgctgcaaaatgagcataattgccaaaccatgtagtactagaaaataaaaagaaaactaataaaaaagtattattagttcaaaggagcagaaatatgcataatatcagtagtttagaaacgatatctcaaaaggcaaattgcagtattataattgatagaaaatgaaattcatggaaatcaaatacttcacaataaaacatatttgaaagtgagaggcacctcagtcccaccaggctgacttttgcgtttcttccccttgactgcagttttaacatcgcagagatcaaatgtaataagtatcatacaaatcagaagaaccatgaaggcatgaaccaccagagacaatgatacaagaactttgaaaaatgtataagtgaacttaccaataatcttggtgtcctctttatcagtttttgcatctgctgaatgcaattaccataggtaagtaagatatatttaattaaaaaagtaagacattaagtggaaacccatccttaggtggaagcatgggaaaaattttggtataaccactataacagcatggtttattccattcccaatgtagcaaatagagtggtagcacccctttaaaaattcaatgtgccagaaagaaaaataaatgttgcaaataggaacttctatcttttctttccctttggtttaccattggtcatcatttcttatttctagaagtacaaataaaattacagttcaaattcaataaacagatagtttaacaattgaaaagaacatatacaatgttctaagagttttcatgctgaattggtatcaaagccatggcaattttcatgattggactgagagatagtttccaccataaaacagaaatatgatcatgaattcataaccataccaatatgaaaaagtatgaacgggaaatttcagaatgtcctatatgcgtagtaccaacacccataacagtaatctaccacgtactgtacactaactatcacaaaattactccaagattggttcacaactccaaactttggaagaaatatctcccagggtgaagtttgagcttaatccgtcaatgtaaatgatcacagcattcagttataagttataaccatcccatattcacaatctctttgccatttggcatttctactcttttaactacagattaagcatttccaagatgattgattctattagcaaaatacaaaatttataatagaaacataacactcacagctatagaacatagtaaaaacgaccatttggcaaaatagttcctagaaaggaagctcccagtggaatagtctagacatgatccaacagcacaaacattgatttaacacacagatagcttgtcacggatagaagtaaaaactatcgacccagtaaaaaagcatgcgtaatcaattccaatggaaacaatacggagaagagggaggaataagctaaccattagaaccttttggcttatgctgcgctgaccgtccagattttacacttttgtcaactgcttggctcttttcaagctcttgttgtttgcggatattttcgtcggtcaatttcagtaagcgatcatttgtgacccattcatcccagctgtactcattgaaaataaacacaataagaagactgtttacttggattaggagagcagaaagacaactaaatagcctcagtgcaatgatagaaacaagcccctcaataggattcacgctgtactcattgaaaataaacataataagaaggccatttacttggattaggagagcagaaagacaactaaatagcatcagcgcaatgatagaaacaagcccctaaacaggattcatgaaaatattaagaaaaaaaattgcaacgtaagggcaaagatgtgagactacccaaacatggtgttagacaacaatatggccctgccagaaaaataaaaagacactagaacatgcataaggtaatccatatccagctcaaggtccaaaatccaacttagacacttttaaactgtcaaaggcctcagtgaaatttttcatccggcacaagtattaaacaaatttgtgttgccatcacttcaattcacacatggaaaatggattggtcataattaaaaatatgtcaagtcatctgggctccaggcactcactcaggtcctaaatcaaagtcaacaaaacaggcataggatcacttccccaactgagacataacagatcaagttctagagatgatttcatcaacataatcattcaatcatcatatgtttcacaaacgaatctaatggtttcatttacaagtgaatctataaatagcatttgatatattggtggtcaaaactataaaagtttgattcgacggtttcaaaaacatcatatatttccattacacaacaaagagacacagatgtagcccaaagtctgttctgaattctatggctttgacatgatgctatgctgtagttctgtattaatcagattgaggccagtgcagattcatgagaagatttgcatactttcacatatctcatggtactacatgtaaaaataatgtcaattgcttgatagaataaaacatcaaatgcatcatacaggtacaggtacagatcttccttgtatggttagaaaaatattcacatcaacataaagaactggaaagcattggtaataagttatcagctataggtaagcatggaagacttatcgatcatccatggtatgcacttgcctcttactccaaccctagaaaagaaaagaggaagattaaagcaagacaaagaggggggaggaggtgccaaatatattatacaggtaacgtggatatcgtaagggaacacccaaagttaatgcatcatttttaagcacttgtcatggtgtacaatggcgacggagacttacaagataatgcacgtgataccgccactcatcctccttgttttcggacttttgaaccttgagaaatccagaagacaaaatctattggggaatgcaattaacaagcgaaagaaggctaggaaattcaagtatgggagcggagcaactatggaggccatttgcagagaagcaaaattaaatgaacgaaatccggaggggaggggaggggaggggactagaaccctaggttggattggagtggaatgggagataggggcggaccttggcctcgtagaggagggggccgtggtaggcgagcactctctcgccctccttgaaggacggcgatgtctcgtcgtgcttgtccttgccaccgccgcttctggtgttggtgttggtgttggagctcccccccatgccaaatcacccaatcttctttcttgtagccggcggcggcggacggcggacggcggacggcggtgggcaaagaggcgtgctaatggcggcgcggcggggcggagagagagactatgccggggcggttttgaacgttggaagccaagcagtaggggctctttgtggatcggaactgccgatttctgctttactaaaaagaaagtcgcaacgggaagaaaagatatttacatcgaaatatttggctatggttggatttaatctttagtaaattagtcatcattaataacactttttcaaaatttgttggaatttctagagtttaattgtcaattttgattatataaacatcattcatttcagtatttatttaaataaaaatcatcattcctctttgggccattttcagcccattcttccttagcccgcaaccgagtcggcctactttcctctcttctcctccccttcgcctcagcccgcaagcaagcgtccagcccagcaagcaaactaaagtctaatcagcctctccaagtactactctcactatcatgtgggccctaactgaaagtataacctaagcgtagtgttggacccgacagacagcacgtggcccagcaatgatacgacccgacgatggagaccagctcgatatgggatcgatgtgagcatctgagtcgtcgttcgttttgatggatggctcagctcagatcggttccaaatcaatcaaaaccacatgtgccaaaaaaaaccctgaccctatttcattttttccctccctttcctaccgtcggccgcctctccccctctgtcgctctctctccatcgcttcccctcccccaccggcagcgccgctccttctccccctctcctcccgtgtcgcaggcacggcacggcgacggtgagagtacgacgcgatgcagcaatggtgggtacggcacggagacggcgaagacgacagcgacggtcgtcccacctcctctccctcttcccgtaggcctcgacgccaagggggagggtacagcggccataggcgatgacaacagtgatgccgcttcccggctaagggctggatgcaccccgacggctcacatcggtggcttaatgctccatgaatccggtatgtgatccaaattaaaattatttgccacttatatagacagatcaccctatataaatatatgtatcggctaggttggattgaaatcaatccggaggggaggggaggggactagaaccctagttggattggagtggaatgggagataggggtggaccttggcctcgtagaggagggggccgtggtaggcgagcactctctcgccctccttgaaggacggcgatgtctcatcgtccttgtccttgccaccgccgctgctgttgttggcgttggtgttggagctccccatatgccaaatcacccaatcttctttcttgtagctggcggcagcggacagtggacggcggccggcggtgggtaaagaggcgtgctaatggcggcacggtggggcggagagggagactatgccggggcggttttgaacgttggaagtagtaggggctctttgtggatcggaactgccaatttctgctttactaaaaataagtcgcaatgggaagaaaagatatttacatcgaaatattcggatatggttggatttaatttttattaaattaattaatcatgattaataacactctttcaaaatttgttggaatttctagagtttcattgtcaattttgataatataaacatcatttcagcatttatttaaataaaaaggaataagttcactttgggtcactctatttgtcgcccagtccgattttcgacccatgaccacaaaaacgggtatgacccatcccccaacttacaaaaaccgggcaaacgtggtccctcggtggttttaaaggtggttttggctgacgtggcgcatacgtgacatgtttgactaggtctccatcccacgtgacattgacgtggcgcttacgtggcaattatacgtaacatcctcaaattttaaactaaattttgactgcatcatcctggcttttgattaaattagtgtgctttaaaaatctatttgactcttcaattggttcaagtattactttcttagagccctactaatttaccctaattattccctttattccaaaccttagtgaatttgagaaaattctctcaaatttcaaaccatagattatttccttagtttatcctaatattagtgaggatttgctatacttcaaatcctagtgaaactctttcaaattcatagattaaattcattcttttctagggaaatattcaaaaattcctgaaaacactgttcattgcactcaaggtgctcgacaaaatgcccagcccagctagagcagcccaatcaccacccaatcttgtgcaaagtctagaattgatcctaggggaccacatcccactcaaaaaaccacggtttagttggccttctcctcccccttgcgcgcgccgtcctggcgtctgactttgccgcgcgccgagccgccgcgcgtcggtctccggatcgatcgcgcgtgtccgaccgccttggcgtgccgctagccgttcgacgcccttagaccaccaccgctgcaccaatcacgacgacaacgaagacagaacgaccaccgccgcaagaaatcaccgctcgacgccgtgcgcacccgtccaaagccgccgccgagcacgatttcgcttctaccccgggtgaatcgcaccaattcttgccgcacagttggattaaagttagacggtggtttcccctctcacaattcaaaccattcacccccaagtcggctgttttcaccctcgccgccgctgcgcgtcgcgcccggattggcgctaacacatcgccagccgatttcgcacgcggtcaagccaatccttcgccggtaagtattcaaacatggcctcccgccactcaaattgatcttgcccgccctctcacagcctctgccgccctagccatatccaaagctcgagctcatccatggcgatgacggtgcccgagctcatccattcctcccagccctataaataggaccccaatcccttccttgtccatcatcgatcatcaacaaccatcaaccaccatcaccccacaaccccaaagctctgcttcactaatccatcccatcaaccaccatcacccgtcggtcgaacaccttgtacgcgatcgactccacacctctccctccatcctccgccctaaatatcccttagaacaccttatatcaactatgttctagcatagtagaccctaaccaaagtcctgcgtcaagttctacctcgtcgcgccaagccgagcaccgccgcccccacgctgctctgttcttcgccgccgcgaggtttttccggccgcaatccttcatctcgacataactcagtgagttcttccgtttcaaccatctacatactacctagattccattttagcaatccctttgcactatcatgccaccctctgagctgccgacgtgagcacggccgccgcctatggcggcgctcgtcagcaactattctccgcaccttgccaaaggtcggcaagctgccggaatccctccaaacacctcatagatgctctagaacccctcccctagccatgtctaactcatattacttcgatcaccaacacggcctaaccgtgccaccgccgccctagccgccaacccatccacatatcaaattaatccctccgccgccgctcgccgtcgccggagatccctagctccctcccctcctcggccgcaaccactttctccctctagcgccgccgtaatcccaaaccctagcgccgccggcccgatttggggaacggccgaaggtagaagaagggaagagagagagactgacaggtgggacccgcacacagtaacatttcacttttatttgattttcaaactttaaaagcccatatattttaaaatatagatccaattccagtgaaacttggaccaatattcttctaaaatcattctctatcctttgagcctctttttgctatttttgcattttattttattttctctatttttcatatttttggattttatttgaattccttttaaatttgaattttatatatgtctaaccctaggtcttgaggattcttctgactcaatagataatatcaatcaatctcaggacatcgagcaaggcaagttaccatatacctgttgatcatttaagcttatattttacaaattatttatttatagccttctattcaatactctattttatatgcacaattcaaccaacaattcaaccatagaaacccagataatttagtattgcttactttgcttacaatctggttaaaatatcttatacttagattgggacagtacgtaagatttggttgattttcgggtggctagtactgtctcgatcgatataagttttaccaggtacttatgtcgaatgaacgggtacgaccacagtttctagaatggggacagacctagttattatattaattagcaatatggcacctctgtatagtggttcttatttttaagtcctcacgtaggaggcaactatagccgcgaagggcaactttaaccattaccatgtacaggtaaatggtttgtgatactcgagtatgaactatatggtatatttctaaaccttgatcgagatgacgtgttgtcatacgatcagttccccttaaatatctcgggaacgccagaactcctcttgctgctgttaacaatacgttcagagcatatgaggatataagttcatggaacaggtgccataattgttaatgacttaatgctgggccatgactaaagcgtacatctgctgcagtagaatatctttgaaactattcgaatagccgtactcatggagttgagtaccgggactcatatgctaccctggttagaaatctaaagtttataagttttacaaattcttgctataactcttccaaattgtttattactactttttgcaaagaaccctactatatgtcaatgcataacatatttccatgataacttgctgagtattgtaaatactcacccttgctcttataaccccttcttcagatctgggtcaagaggaggacccttatgactattactacgatgactccgataacttagagaatccctaaaggttatacctcactagtcagaatgtatagaaacttccgctgtgtattaaatagttaggtgagtacctattattgtaaaacccttagtattgtaaaactttaaggtatgcaatgaagaaccagttatattgtatgtatcaatatctactgatccagggattgatacattaattctagtcggatccaagttattagttttgggactcgacaggactggtatcagagcatatgttttgactataggacaaaccctaaggattactaactaagttaagtttgaacttatttcaagcttatctttttaaggggggtagatttaatccacaagcatgcattataatgacatttgtatatttcaagacaatggcagaagagcatgagcaagaacttgtagaaactgcgattactatccatgataatgactgcactgatcaactaatcaacttgatgactaaactgaagataaatgagaagccggaattctattcacatgcctatcaacggggagaacgttgggaatattatatgaccgtgaagatcaatcctccacgaggtgaacgtgatatgtattacttccaaacacatcataggtggaataccatgcgagctgcactatatgatgtgtccagggaggcttttctacgtcttaatcatatctaccgagacaggttgcaacactctcgctattcttatcatcctatgcgagagccaggcgaagattattgtaccctccagaatgtggattatcatgaacaaccagtgaaagcaactatgtctatctggatggaagccgcggatgacatgtatgaagaagctttggaacatatggatgtacaacataaacgtttggaagaagctgaacgcagagaagctgttctcaaacacaaatatcgtatacttcatgaattatatgaggaaagagaaaaacaaaattctatcctcaatatttgtgttgtaggagcagccccacttgcgattgcggtccttgcggatcctcgactatggccaaccttggtttgagcaatccgtgcggagcgtgtacgtgtcactgcacctgcacttgtagctgccgacgagattggccttgcgctcgcgcatttgctctgggattccacgcttggtggttgaggcgcttcctcaatggcagtaagcagcgacgtgtatggcgagatggcgggtggcggcggcacagagagtggcatgtggtggcgggctggcggtagagagtgccggcctgaccgcctgagttcctggcagtggcagcttgtcacgcggtggcggcgctgatggcgatgggggttggtggcggtggcttggcgcggtggaggcgtggagctcgcacggcggcggcggcttggcgcggtgtggagagctgcgactgcgagcccatgatgcgccgccgatgcgagatgcggatgccgagagtgccgagccgccgatgcgatgcgagagtgccgagacggcggcggacagggagtcggccagtcagggactcgcttctccctagggtgaggtgaaataggatttttttgatgggtctattaggccaaatgggccatatgtatgtgtgctgttggctgtggacctgacttggcctggtaaccccttagctcgttaaggctcgcgagcagctaacgagccaaaccaagcctgtcacgagccgagcgagctaatgagccacgagattcctgtccgcccctaaatatggatacaatccgagtagtcgttatcgtttccatataaaactctacttgtccttccttacgcggaactccttctatatacgatgtatgattccgtataagacttggtatatggtgggccccggcgagcttaatcgattaatattgggtatgtggtatccataactatgacacaaacttctataaggaaatcaatctataacaatatatcaaatagagatcaattaccaggtttgacaatctagccgatactgatctagacttatatatttatacaggggagggagaaatgaagtagggttagggtttttttttggccccggtgattttgattgatttggaaccgatctgagtcgtccatcaaaacaaatggctcagatgctcacatcgatcccgcatcgagccggcctctatcgtcgggccgcatcactgctgggccgcgcacgcctgatgggccacggccgttgggtctaacacaaggttaggttagatttttggttggggcccacatgacagtgagatgagtacttggagaggctaattagactttagtttccttgcttgcgggctgaggcggaggggaggagaagagaggaaagtaggccgactcggtagcgggctaaagaagaaaattggctgaaaatgacccaaagaggaatgaggatttttatttggaataagttcactttgggtccctctatttgtcgcccagtccgattttcgtccctcgatcacaaaaccgggtatgacccgtcccccaacttacgaaaaccgggcaaacgagatcccttggtggttttgaaggcagttttgtctgacgtggcgcctacgtggcttgtttgactagttctccgtcccacgtggcgctgacgtggcgctgacatggcaatcatatctcggaaaaataattaaactaattctctctggctctccccatctctcagctccctcctctcgccgggtggcgtcaagcacagcgggcggcggtagatagcacggcggcggcgtggcgacggacagagcatggccagcggcgggcggcgcggcgacggacagcgcattgccagcggcgggtgacggcgcgcgaggcgcgtggggcagcggcggccatctctctcttgcaccgctcgcctagccgtccgccgcccttctccccgatggccgccggcgggagaagagggagcggcgcgcggcagcgttggtggcgagagaggagggagcggcgcctgtgggagaggagggagcgacgcacgcgcgcttgccggtaggccagggagctcacctagccgtcgcagcggaggagggagaagaagccgagggcggaggccgggtcgggggaggaggcgagggtgtggagcgtggtggtgagcatgaaggaattgggggcacaggggagggaggcgaggaggcagagcacggcgtcgagaggggagagcgcggcgtaggcggcttgtggaacagtggcgggaggacgacgagcgtggtgtagaggcgctcggcgatgccggtggtcggtggcgacacacggatggtggcatcgatggcgtcttccagggcgccgccgctctgctcgccttcacgcggaccggcggcgctccggtcggggggtggtgcaagagagagatggccgccgccgccgccggagctcgcctgctccgccacccacccgcgccatcctctgctggggaaggggagagaggggaaagggaagaagggagagaagggagagggaagaagagaggagtgagactgacatgtgggataggggccccaccattttaaatttatttttttttgcatgcggggcaacgctttttattatttttctgagatataatgtcgggtcccaaaaactaacaacttggatccgactggaattgatgtatcaatccctggatcagtagatattgatacattcaatatcactggttcttcattgcataggttaaggttttacaatactaagggt

SEQ ID NO: 69597 - DNA, 2412 bp, Oryza sativa
  unsure (1)..(2412): unsure at all n locations
catttttgtactacctggatgtaaagagtaagctgaatcatgtgcttcctttagtattaccttcctcaagtttcctgattgtggtacgacaattctatttccgtaccataatattccttccaggtcgatcttcagtaatatctgcagcctttccttgcaccttccgttccttaaaagtttgtattcagaatcttctttctgatattcttttatttgatccatcaaggtaggttttaactccaaggtgtttaattctccaaacttaataatacccagatttagtttaagcatttctgcttgcaattgttctgatactatttcttgttgtaaattgtaataagcttttcggcttaaagcatcggcaaccacgttagcctttcctggatggtatagaatttccaaattgtagtctttaattaattctaaccatctcctttgccgaagattaaggtctgtctgggtaaaatatatttcaaactcttatgatcggtatagatctttcaatgattcccaattaagtagtgtcgccaaattttcacgcatgtaagattcatgaagtaagcaggagcgttggttaatccaaatgccattactgtaaactcatataatccataccttgtcacaaaaccagtctttggtatgtcctcatgtctaattttcaactgatgatatcctgatcgaagatctattttagaaaatacacttgctccttttaattggtcaaatagatcgtcgattcttggtaaaggatacttgtttttaatagttacttcatttagagctcggtaatctacacacattcttaaacttccatctttcttctttacgaataatacaggagctccccaaggtgaagaactgggtcgaataaaacctttttcctgtagctcagctatctgtttcttcaattcttctagttcattaattggcatcctataaggtctttttgatataggtgccattccaggaagtaactctataataaattctatttctcgatctggaggtaatgaacttagttcttccggaaatacatccaaatattcttgcaccactggaacttcttcttttggtataagcatacagatgtctgtcatatgttgttccatagataaattggatttaactattatccttgtatttattcctcattcatcagtaaggataacctctcttgttgcacagttgattagtccattattcttggctaactaatccatgcccaaaataatatctatagtttgggtaggtagtaccatcaagtcaattaaaaatatttgatctcctaatttaattggtacatttctacaaatagatgatactaatacagttcctccgggtgaatgtattagcatagccttatctaaattatctttaggtaaagactgattccaactggcttttgcagataaaaaggaatgagaggcaccagaatcaaatagaacaataactggtttagagtttatggtgaacatacccatcaatatattaggatcttgttgagcttcttcttctttaatatgatgtacttgaccacgtccaagattaggtccattcttaataattggaggatttttctttataaaacccgtagcagatggtttctgataagaagtttggccacccatattttgacgattagggcaaagtcttgcgaaatgtccaattttcccacaaacataacatggagagtcttccatttttaatccaggtcttggtagtattggtggcatgcctggccttgcattgggtagagatggcttaaatggataaggcctccgaacttttagtgaacttctagttggtaattgtcattgtaaattcattcttttcttacggagtccttccaccattctacgatcattttctagcctaaccactttattgactaggctttgaaaattttcatgatcttgactaatcattggtcctcaaagttcatcacgtagaccttctataaatctttcaatcttctctttttcatcttgaatatccgaggcagcatatcgagcaagttgtgtaaatttattcaaatattcttgtactgtcataaagccttgcctcaatcttcgaaattcattctttttcatcctaatcacaactgtaggtataaaagcatctctaaaagctgtagtaaattccatccatgtaataatatgtgtaggatcttctatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69598 - DNA, 24691 bp, Oryza sativa
  unsure (1)..(24691): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaccaaatactcctactccgcgaccttcattctctttcctgcaaaagttcagtatcgttggttttaccaatgaactaaacaaagctcgttaggttaaagttaggtttacctttggggacagtaatcctgaccagctgtagaccccgtgagaaataacacagagacgtgcgaagagctgtgaccgcgttgccggctcagctccacagctgtaaggccagcacacaccgtaggaccggcacgtggcggccagccacgacaggataagccgatagactgccccggtgccgtggcgtccaggcttaagccccaaccaaaatctgccacgtaacgtggaagctcacgtgggcagccagcactgcagggcccaggcggcggcgccttgccgaccttgccaaagctgagagctccccgcgcctcgccgccgtcgccaaccggcggctttgaattgaggccccagcaacgttcaaacgtgtatccataccaaccgcagccgagcatctgtggtagtatatgcccgtggcatgtcgggaacgcaaatatcgcccagcgcctaacatactagtactaccaaccaaacattatctgatctgatcctgatcctgatccaatctaatctcacatggcgcactaccgttctcgtcatgcagatccagggaggacgcagacggattagcagaagatcagaagaatacgattttcttttatatagggtattttgtagtagttgtagctctaacttgtgcagttgtgcaactcctacaagtagatcggtacggattatgtgtaagacagcaacaaaacagattagccgtcaacgtagccagccaagctctttaaaaagcattaattaaaaccactaccaacagtcaaaccccccaaataaacggaggcgcgcttctactgcccgtgaggcacaacagatcgttacgatttcgaaccatctccatgtcgcatgtcgctgacgacggcagctggccctttttactgcagtcacgggtgagcgaacggccgaagcgacactggcgactgggccgtcccccaccggttgccccgccacgccgaagcatcgcgtgcagacgcagacacagtcaccacgtagtcaaacacatgcccactcgaggtgatatttttccctctgcgttgcacttgtgtgtggcgtacacgtactactaccggatacagtacagtcgtagcgaacgtggctgagttatgggcgtacacgtgggtgtcgcgaggcggagccgcggttgcagtgggaacttgggtctcctccaacctcgtatggtcgacacgtcacggtcggcagcgagggttgacgtgaaggggattgcgggggggactgacgcgtggatggtgactcccggtccccggcacgtgccgctccggcgggtcagtccatccatctggctcactcgtcgctctgtccacgtcggtcggttccaccacctgggtcagtctttttttcgtttttttgactcgtcgctggcttctaaaaagtgtagctaaatttaaatttcaaaaatatttcttttttttgttacgagtactcctactcctatcatttcgtttcacccttagggtgtgttttgttcacgccacaattagaagtttggttgaaattgaaacgatgtgatggaaaagttgaaagttcatgtgtgtagaaaagttctgatgtgatgaaaaagttaaaaatttggagaaaaaatttaaaactaaacaaggccttatcttcgaaactgttgaaaacgaaaacgcagtaatataaggtatgaatgaggtattggcctgttcgactgctagcaacagtatcggcgatacggtatcgcgcacacgcgacgcaaacacagctgcccatctgctgaacaagcttatttatgtgaaaaaaattgctccaataaaaattgatgttttaaagagacgagttaggataagcactcaacatgaaataagattaatactattcgcacacatgggtgcagccagtaatgaagtctactctctttaataaaaaaatataacttaatggaggacaatccaaatttattgttttatgtctcatttctaattaagatgattttcttttatggaggaactctatctatgtgaagctaggcattcaacgtataatcacctgcgcgtgtatgtgcgcgtgagcacaaaagtggtgtgtttactcagttaaaagaaacttacatctataaatacattttagtctacacaagagtataaaagtggtatgtctaaattcgtagaaatagataattgcttatttgaccctgttttaaagcataattatcaatttgaccctacttgtttttagtttacttatttggacctgtttttcaaaatggaatgaactatttgaccatgttccgttaaggcgggttaacacggttaaataggggccaatagtccattttacccttacttatttgacactgttatatcaaaatatacatatatttggaccttttaacaaatctaaatcaatttgacaaatttaatagacagtagctagagctcggaggttgatgctgggtgccgctgtggaccaccctttgcacgccgccaccactccaccgcacgacagcacgcgcggacgtccctacacgcaccgcacggtggcgccgacctccatctgcacgccgccgcccccgaagccgtgcgccggcgccgcgcgatggcgccggcgccgacttccctcagcacaccgccgccgccgaagcggtgcaccgctgccgacctccctacgcatgccactgtgatggcgccactgccgacctcccaacgcgcgtcgcgtgacggcgtcgccaccactcctccctccggtcctccgccagccaccgtcgcctgcctcaccgtgcgccgccgccagtgctccctcccttcccacagaaccgccgcctccccatcaaagtccgccaccgctacaccgccttcgctgaccgccagagctagatccgtcgtgcgcgtgcctcggcaccactggatccgtcgcctcatcgccgagtacaaaagtggtctgttcaaattcgtagtactataagactggctgcgttcgttcattggagataggggagattgtcactcgttttccgcgcgcacgcttttcaaactactaaacggtgtgttttttacaaaaattttctatagaaaagttgctttaaaaaatcatattaatccatttttgatgtttaaaatagttaatactcaattaattatgagctaatggctcacctcgttttgcgtatcttcccaatcctctctccctcgaacacaccctaatgttttattcggttgtatgttcttatattttagaatcgagaaagtaattaactggaatagttatttagggcttgttagtcagggatggaaacagttaaaatgggaacattaattataaatgtgggccatgaatggatcacggacagtagccacgcgttgatcctatccaatagcgtagcacggccgggggaacggtggtccccagcaaaaggagtacgagaagaaaagaatggagggacggcatggcaggcacagtgcaagattgtggggcgccgccacattatcctctctctcccccggcccgtatttcgtgccgcgtaagccaaccgggtgcgtgcccctggcccccactcgcaacatggcttttgctacagctatagagtagttgtactccagtgggccatgcctccatttataactccattggccgcccgtacggatttgctaccaacttgtggaatcaacaacgatatcgttaacccatacccgtaatagcttcgttagtttagtgatcatcgtcacattttctatacttagttaagtttagttaagtatacgggtttttttagttaagtatacgggtttagaaatgaaaattaaagttcgttactcggatacgcttacatcgttttttaatatatagtcgcaataagtgaaaccaaggtaatcttttagcttgttaatgttagcataagagatcactattttttttatataggccttgtttagtttcacactttcaactttttcatcacatcaaaactgtcctacacacgtaaacttttaacttttccatcacatcgttccaatttcaaccaaacttctaattttagtgtaaactaaacacacccatacttaatattttttaacttagaacttaatcttttaagtattttagctaatatttaattaattatgtactaatttaacgttctttttttctgcacgaaggattaggtggtgtttggattcagggacttaactttagtgtctatatttatacactaatttatagtattaaatatagactacttacaaaactaattacatatatgaaagctaattcgcgagacaaattatttaagccaaattaaatccataattaaagaatatttactgtaacatcacataggctaattatgaattaattaggctcaatagattcgtctcgcgaattagttcaagatcatggatgggttttattaatagtctacatttaatatttataattagtgtccaaacatcttatgtgataaggataaaaagttttagtcccatctaaatatggttttagttccaacccacgtaaaagaatacagcctaataaagtaatagtgctaacttagtagtattatcttcttctctttttttgcccagctactagttgctgctagactactgctgctgtgctgtacaagcttgacaggatcatgaagagaaggttagaatgtactaagaaggtgaggtgttattccaagtcttgatcagaaagtaaagcacgcgatctgcaaaaaggggaaatcctcggacgggataacataatcaaagcaatgtgcacagtgacttttcgcgcgaaaaaaaaacatatattagtacgtactgatcctgcatctggtcctggtgatggaattaggtatgggaaagagataaataatataatgggcgaacagtattataagggtggacccggcgctatcaagaacgtgaaggcagtgttttaggatataataaaccaaccaaatcttgacgtactggtagatcattaaagagatggtcctccacgcggccaattcattaagaaatcgataattaaagaagggattaccactacgctagcagtagcagtagtagtagtagcaggtaggagtaattgttatccggataaggttactgcagctggagctagcattatggtacttagtttgtttaggttaatcctcttctgcgcccgcactcagatcggaaaactgcaaattgctgtaatgctgaagctgtcatatgctgtgtctatgtggcccttttcatttgacccgtcttttagcaattttcacacgagaaattccgacgttttcacgctgctagtcgtgtgctcgtgccgggaaacagccaggcgcgcgccgcacagatcaacatcgtgtgctgcacgccgcgggatcggggcacaccagtgaaaatcaccaccgccagagtcaaccaaaacgtacgcgtcgtatgcgcgcgattcgtcgacgcgtctcgtcggagcaggcagcctctcgctgtcgcccgcgtcgcgctcgtcgatctcgatccgttgctaaactcgaacgggaatgcgagctaattacggggtttagcatgtgtaataaggtgcggtgattcgatcgatcggcatcctcgtgcatgcgagccgtacgtaccggcctaccggggggatcgaaaaaaatcgtgtgggtctctagggtcccaagtgtaatcgcttccatgatttttttggtgaggatgatgtatgatgttgacgagcaactcagaaaactactatctcctcaccatcaccacttttatcctctccaaaaaaagagtacgaagtagatttcatcagatggacacttggacggatggtggtgctacgatcacgatagatctcttggggccccttcccaactgtaccagattgcttaaaaaggatggcactccatgtctcacctgaaaggctgatgactcggagctatttccagacgtgctagaaggtgaggtgtcgtccaacgacaccaccacgcaacaatgctcgtcagaaatatatcgtgcgatttctgctgctgctgctgtgtgcgatgcgaacatttcgctggagaaaaagaccagcgcactcgactcgaccaccatgcatgcgctgcgctgcgctgcgctgccatgtgtgcgcctcggctcggcgacagcgcacggcgcgtatgcgattcttgccttggactccatgccattgcagcgccgtgccatgtcgcgccgtggccaggccgccgcgccgcgccgcgcccaagtctttgactcgcgggacgcgccgcgcgcgcgcttttctgcgccggaatgcttgaaattttcgaccgatcggggccctcgttctcccgacatctccgcgccgacactgcccggtaatccgcttgcgttccggtcaactcgtcgcattgctcgcgatggatttcgtcgcggtgcgtacactggttgcattgcatggccacttggccagcaacggcgacgtcgtcgtactcgccgttttttcactcatgtcgttcgaccacaacacaaccactacacacgactacacgagtcgcgactcgcgagtgagtacactacactgcacacgaaaggaacatgacgtagccgtagtatcgcccggtggtcgagatgtcgaatgattggtcgcatccaacgatcggagataagaatatcgtatgctactcgatcgtctgtactactgctattatcgcaaaggctaaaagggggattagctagctagcgacatactcacattggggataatgatgctgtggctatagtgcggcagctgctgctgggatgacaggatgagggcagtgggtacaggtgttgcttttgctttctctgcagatcttcttcaatccatcgcgagatctttgccgtgattgtatgggtttgaccctggcgaatttcggttggcaattgcttagacagttcgatcaggatcaattcccttttcatttcggcgacgtcgtcgttgtggatcagatcaaagagtaggttatggtataaaaacagtacggattcattggaccatcctatacttgattagcatgttcaaatcctttactccaggaatgtttggcagcattccggctcagcatgtttcaggccaccaatgccatcgaaacatgggtacttttttgcacagaatacgccatgttatccggggtatagggcttcggtttgttgatggcgatcttatctcttcccgttttgtggcgaactaattgcgaattatatattgcacgcgcgagaccgtaccgaattagaagtccattaagaaaataaccgaagaaatgaagttgttggaacgtaggagtaaatctactttaattcatatctgcaaatcttgctccagaggcaactaccagcacatttctgtgcctaatccataacaatattaaattactggcacacacgtatgcactactaccattgtagacttggtagtagttgttggcaccactactacctttcgttgctgatctgggtcatgaccattctgcccctgagaatgctatacattcacaaagtcaacaggtcatttgtaagtgtacccgtatatattggtcagctcctgtggtctccgttaatatcggctcgttttggcatgactttatcgaataaattaaatcaggtcaaaccaataatcgagtttgctcgaacaaaataggtgtgtgtgtgtgtgtatatgcaggatgcttaggagacaggtgctgggatgcaggctctccttgcatggtctaattggtatttccatgtcgtgcagaaataattgggaggagatcgtacggctccttgcataattgcattgtatattatattgggtactgtactaatttcttcatctagatatataactagatttagcatcgaccaatgaaacggagtaactggactgcacgcaatagctagctactccagcttgtagtttggtcacacaagctaggtgaggaccagggacaaaaggaagcagagagaggacactgcatgcgtgtcttgtgtcgtgcataatttggggttaaacatgcgttcctgctgctatcaatatgcacgaatccaaggcaaaccaaaacagtagcaaccgataactaactccgaccttaaattaccacggcaatttgtcacgaaccaacacaatcacaccaaatctctcacataaatgccaccgatatattacaatccactcaagaatataagtgtttagggatacaaaattgaggagaaagagaggtatagtttgagaagagagatcagacaagaggaagcaggagattgggactagagagtaggaattgagaggggaagcagcagcaaggaggaggaagaagctatcgtctgaggcgttctggtaattgattcatcgatgaccctggctgctggctgctggctgctttgcctcttttctagtctccttctccctagccgaatgggcccaaagccagcccacttgtctagcctcctggaaagacatcacagcaggccatgtacatgacattcttcccccgttaagaatcggcttgtccccaagccgatgcaactgactcgccagattaatgcccccaagatcccaaggtacctgcagggaaatgccttgttgggcagaatcccagaacaattgtttgatgaccttcgaaccatctgatgtagaccctgcccactgttgatccacttatccaacatacataaaacctgagcattacaaccacactctctaccatgcttttgctgcctcaaccaccaagccttcacgccttcttcaccactactatcagcatatactccatgagagcccagatgtaacatgcaaatattgagatcagtgggctgagaaacatgcatatgcttctttgtctgaatgagagctacttctttgtttgcaaactcccaaattgctaaaaattgtatggttttaccttgatcaccaaccaatcttgcatcaactaatttaaccactcgataggcccatgtgtgcaagactatgctgtcctcacaaactaaacaaatgaggcatctctctgaacatttaaccagttctattccacgagaattcttactgaaagtgctagcttccaaactgagatggactgcaccaagtttcagctgctccctttgtaacaatagctcatgtgtctgcccatgttaattattccattgaagaataagctcagatgtacatagcaactgttgtagcactgcccatattaaatcccaagaattggcaactgacagccataacaccttgtttgtatattctcttctaataactttcacatttgtccataacattagtttcccttcagatatacacttccaagaaaaattgagcccttgccctcctgctgcacacaaactgaatacctcactcctccattgcgaaggaggaggccaaggttgcaagttgaccaactttcttgttgaaaccctaaatgcctcaccattgtttgatccaaattgagtccaagaagtatcatctagtacatcattgttgttactctgaacctgaaatgaaattggaatagtatagaaccgagcatggcgatgggtacgtctctcatgtgacttgcaagtgcaattaccatcaacattagctccactgaacaaacaatcacaccatgcatcgggtgatagatgggaaatcagcatcagcagcaagaacaattcatgatccccatatgcccaaccataggttgaatgatgtgtgtgctgataggccttcctaaaggcaccagagagacatatctcataccaaatacaccatccaacaatcagattttgcagcaagccctcagtggaattaattgttctactcatgaattgggcaacgctgtagttcaaggagacttgatgagactcaccatataaattcagtgtttcaatttcagctcaaacacttgtttgaataagtggcggccagggttgtaagagttttaccaccacgcctccgctgccttgacaaagctgtggatcaagccatggtaacggccgagaacctgaggtcatctcagctttgttccgtggaattgctgctctccaaggtggtactggtggagggctagctgtgtattctgagctccggtcaaagcaaccatagagtacttccaatttcaatgaaacgaaagagaggccgacaactccaaagtagtcacggctcaagcaccaactccagttcctgggaggaattgcattgatgattaacaatggatctctgaagcataaatacatagtggtgaacttggtatctacttccatgagctccatccactcctccttggccatgtctttgccaccatcatcatcagccaactggttctcacacttcattgaacactcgatggttgttcccatgccaagcttggctgtgtcaacatggttagttgagccggcctctgtactgacctccaatgcgatggaagttggatcagtgttggcgctcaacgctgccacatctctagtggaatccttgctcaaggataaatccaccttggtgtggcgaaatgcctccagcatccgatcgatcttggtgcacaggtcttgaatggtcttgtctaagttctctaccgccttgtccatgtcagtctcagccttcttggtctcgttgaaaggaaccgatgtcaccatggctgctgatgtaattgagggtatagatgaagctgttgtagcagggaacacgcgttctggtgtagcagcagtactcttggccgctggcctggcggtggcgctacttggtaccattgtcaaacaggtggtgtgcgtggtggtggcgccatctccagggaacatctggacgtgctgcacatccattaagcagcccccgtcgtagatgtcgcgaccgtgggtggcggaccgagccctctccgcgtcatggctggacataaatgacacaagagccttgacttgccatgtgctcactgcaagaacctgcaccgccactgctccataggtattgtacacttgatgcaacacctcagatgtcactggatatatgatctggctcacggtgacgcgaaggacagcagctgaatcgcctcttggacaggtcgacatttcatcgaacaggtggtgggcatctcctccaaagacaccaccaccaagttgttggcagttcctctgaccaccagcgctctcccacttcatctccacaccagaaaccccacgaattgactgctctgataccatattgtcacgaaccaacacaatcacaccaaatctctcacataaatgccaccgatatattacaatctactcaagaatataagtgtttagggatacaaaattgaggagaaagagaggtatagtctaggaagagagatcagacaagaggaagcaggagattgggactagagaataggaattgagaggggaagcagcagcaaggaggaagaagctatcgtctgaggcgttctggtaattgattcatcgatgaccctggctgctggctgctttgcctcttttctagtctccttctccctagccgaatgggcccaaagccagcccacttgtctagcctcctggaaggacatcacagtagcccatgtacatgacacaattccgggctagtacgggaccaaaagcatggaaaaatcatgctttctccaacgaaaggataaggctcttggaaacagctactcgatcgtactcccatgaaacctatattcaaatacgtagtaatagaatacgtcacatccaatactatgttgttatattatggaacggaggtagtagtatcgatggtgtttttaagaacttctcccaaaaaaataataataataaatctctaaacagtttttctttttatttcattatgtaaaaaaatagttattgaattaaaaaaaaggtaattttatcatccttaaatttaccagaatgtatcacactttctaatgtaaaatttgataaaaattagtctaaactttaaatacatcgaaatactttttctaggatcataaaatttctcactaaaaaaaactaaaagctaaaagctggctttctcatcttcttcaaattgctaggagctaattaccgatcaataatttgccataatcttttgcggatctaaggagttgttggtacgaatatcgccgacgaggcgcgccaaagatcacccacacacacaacacgcacctcacctcacctgccctccgctgatcgaaattagagcaagcccagcagagcttccatccggacatccatcccatgtttggcgtatggaggtgaaaaaacacggtccagcagagtctccattacacacgccattttagatgtcctccaaaccaagccctctccatgccatatttggcgtttctctctcctcacgccattcccccaactgcccagctccgacgaactcgcgccaccatccgaactgtgccaaggggaatagagaggatggacataccgggtctgcagttggagatcgccggagtggaggccccgccgtccgcgccgccccactgctcccgccactgctcctccgccgcgcgccgccaccatccggactccgcctgcgccgcccccactgcaggcgccgctgctccttcgctcgtgctggagatcgccggagtggaggccccgccaccatccggcctccgcccgtgccgcccccactgcaaatcaaccggcgtcgctgcttcttcgcttgcgttgcccatcgcgactccgtccgtgtcgccgcgccaccctgccacctgcaccgctgtacctccgcccatggcgccctgcccccgtcggccgcgccatcctgccgcatcccctccgtcgctcctccgcccgcctctcactatctgttggtctcccaggagcgatggatttggtggattttgttttgttttgttttgtttttagcgagaggataaggtaaatgtggctgatgtggttttaaaagaggattaaaggtggtacacagtgttctcaaagtggtaactgcaattaaatcgaaccaacacctattcaaaccattgtaaatatatgcctcttaaaaaatcattagatatatatgggtagttaaaaaatattagtaaaatatagaatagtgtgatatgaatgctgtaatatggatgatttattggagtgggtaaaggtatagaggaggaatcttttttggatgaccattcaaatagaaatatagaagtccaaatttaaatgatctgctgggatgctcttaagcttcttctactagtcctctgttgcgtacgagcaggacgtccaaaggcttcgtcatttaatcgcgtctcgccttgcgcgatctccaatcgagctaatggtggataggtgatcgatgtgttggatattttctggtccggacacgcacactaaaccctatggttggtagcaaaacgcgctgcacggctgcactgcgtcgcgtcgcgtagcatcgcagtgccggtggttatgcttgtgcctttgtcgatggcgtttactagtacatggaaagttggaaacgggagttggttatcgatcatctcgccattattagcggtgatgacacttggctccatcaccatgattcacgattattcgtgtcatcgtgtgcgtgagggcaacagaaaaaaaaggagagaaagataggagtagtactagtagtacacgtgagtagctgttcgtggcatggatgaggtacggctttcaatagtggccggaggttgtggatttggagccttggaggacgtcctacaacggctacaggagtggagttcgtattattggagggcaatggaacgagatctcgacgacacgtcgatatggacacaccagcgcacagtgcatcgcactgccatttgagatgttgtgagtgcatccttttaaccgggagtccgggccattcgattgtctgcacgaggattactgtactgatgtgggccaggacactgctgccaatgtgggtacgtatgggcctctatggcccattaccatcatgtacttacatgatgtgggtcaggccactgctgccaccgtgggtgaatatgggcctccatggcccattaacatcaccagcaactgtatatggctcttactccactatttggtttctggactatgaactgaactaatcagcaatatgttgtgattcacgtcatgtcaagattcactgggcagaagttaaaatataaatggacggaagggaggaacaagtacaagcattcagataagaggatagacacatattgctttcaaatattcatatattctcactttcatagacatagggtgtgtttggttgcaagccacactttgccacacctaaggttaggcaaatttgacaggtgtttggttgtagccacagttgtgacaagattcccctccaacaaattaggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctgggaaccaaacagccccataaaaacgcagattagttacaactccagtcccagaagagattaggtcttcacccagaacgctatcgtcaacatttacaaagagtacaccgaaacctagttacaactaacaagtattacaactccagcaatcttcacaaagagtactagtattatcaacatgcctgctacaccaaaatcaagtaacaaatgaaccaataggaacagcagtgaacctgtagattctcgcaccacgaaaggaacagcagtgagctacacaaaaaccagtagattctcccaccatgatacgcaaagcaaaataagactgtcagtgtaatcgtctattggctaaactgaaggagctgactttcatgggtgttgccaccaccagaggagcctcaggggagtcggttgttgcaaatttctcgtgcatgaaacggctgtcaacaatggattcgtctttcaggacaactttgtaacaatagcagctcttgagcccttcctgatcgcggtagcactcatggttgctgtccttcacctgctgaaagttccaaatgacactaaatttgccaactgtcgcaacaagatgcttttcttgcttcccattctctgttacctgggaaaatcagaacatatagaggaacatacataaggacatatacttaacaaattgaataattatgcagcatgtaggcattaatttagcaagaaagttaacatggcaaatgccaaatgccaaatggacataacagaactgcaggatgaaactttttataatgcacgattgacgtaagtgaaacaactgattgccactagaacaaaatcaacatgattgacgcaagtgaaacaactgatttactgcaattacttcatacactcttatgacaaggtcacaggttgatccgttaaaaacagagctagggcctaaggtgcagggttctttactttagttctactcattagccccttgacaagctgagaattggaacttcaagcaaccaaatgttccaaacaagcagtcaataagcttgtttttaatttaacaagcttatgtaaatattgaacatacttgctaccaatgaattaactgaaaacatatttattagccgtactaccctaaactgggatggatcataactttaccagtttctcccaaaaggtacagcatgattatttcaagatattaatgtgtcaattaacatacataggagatagagacatagagtgaacacattttcctggtcagattgtattataggcacagcaaattactgacaagcagccattttggatatgaaacgcttgcactgactgatcataagtgaaaacaaacttttactatagacaagatagataagtgtagatggtttgctagcatgcacatatgaagcaacattctgtttggctttactagattacaaaataggaacattcactaccgtgtgttctatctcaattatgaaaaacaatatgctgtacaaaataggaaattcacacttacccaagagaactgcccgccatggaatttgttctcggaccctgccaaaattgaatccaatggggagagcttcagcaatcttggtgctgcaatcctatttcccatacgcccactgaatcctgtcttctctttaccatccttgtccttaaagatggtacagatcaagatcaaatatgtatcagtagtgcccagaatccacttcccatcataagtaacatcaacatgtgtgattggtgatccaagccctgggaatgctgtcttcgccatccgcatcgaactcttggaatagagcctaatcttgccatccacagaaccaaccacaatcgaaccatcccctgtacttgcaaagcattggaaattggtgccccttgagaactgatggccctgcgaccattgcagcaccggtgactcagatgagctcccaattgtttgcaccctgcccctggaatccctcatatcccaccggcatagccggttgtcatccaatcctaagaaggttgatccagagggttccagctgcgcgcccttactgtcgttggcgatgtctcgcattgtgatgtcagttccatccttctcaaacctccactgagccacaaccttgccagtctctatatcaacatgatggacgccattggaatggcgagtgccagtctctccagggctcatcagaagcatattcgtctcgccacgcataagcagagccttctgcggtgtcatgtacgcgttcccaccaccacggccatcagatatcctcacagagacgcccttgccgtgcacgccatgccggaaattcttgaccacctgtatccctgaccctccaaccaagaagctgttgtcaagcgcgcccagcgcgaggctctggatgctgccgtccccggcctcctcctcgaactcctcgagcaggtctctcgccggggtcgcaacgggaggggtgaaggagtcctctgcgtcggcccagacggcgtcgtcggactcaccggggcgcgcccacgcggcgaagtcagcgccgaacacctccttccggccctcatccgtggcctcgacgccatacgtgttctcgaacaggcaccggtcgtactcctgccggaatcggcggaaggcggcgtcggtcggcagccgcagcgcccagacggagccgcccgcggcgaaatcggcccggcgctgcgcggggagcgccttgagctgtagcgccgggccgacgggggcggagaccctgggacccggaccaacctccagaacccacctcgggccgccacaatcgctgtcgcccgccgccgtcgccttgtcgacgaaggcgtaggtcgcccgccgctcggccggcacccagcgcgcggaggcggaggcgccgccgacgtggaggtacagcttcgccgcgttcggcgcctggtacttgagatcgagcgctttcagcttcgcgtcgaggaactcgagggaggagggggtagaggtccggaggatgtcctctcgagaggcggcggaggtggcggtctgggcgtcgtactcctcgtcgtcgtcctcgtcgtcggaggaggtgaggtcgaggtcctcgcggctgtgggcgccgcccatggcggttgcggtggtcgacgagaattccgatggatgcttctcgctgcgacacgggaggggggaatggagcggagatgaggggaaagtgagatcgcgggagaggggggtataagtacagaacgccacgtggccgcggtggcgccgtgatggtcggttggtgcgtgcgtgcgcccgacgcgacgcgcccggacgcggcggggacgacgaggtgagggcccacttggcagttgcttcgcccagggggtcaagagaaaagaaaagtaataagtctactttatctccctcgactcatgcgtctggttgaatcgcacccctcaaccgtaaaaccagaccgttgcaaatcgactccctcggtggtttcggaggcggttttctcttacctagcacttacgtgacgggttgacttggtctttatcctatgtgcatcgacgtggcgcttacgtagcactaaagtaaaaagaaacctaaatagaaaggaaaagaaattttgagcctacatgtcagttactcatctcctccctctttattctcgacgacgagcgagatgaagagagcggcgaggcggatggcgggagctcgccggagcgacgggacctcgccggaacggcgaggcagcgggagcggcggcggcgggacctcagtggagcgacaggagcagcaggacgtcggacatgagttgaaggaggcaaaatgaacttattccaaaagaaaaataggcaacctgttgggccgtgaagcccacggaaattcatggatagcatccgctaggcccatccgaggccacgcgtgaaaccagcggcccaatatatatcggctccgctcgaccaccacgctggccgcgtcactctcctccccctcgtatcgctcgggagcggaggtctcctcgcccctagagcgccgccgccaccgccaccgccgcggccgccgcggcggggacttgccggtgccaagtccacacgccatcgtcgctcgcacccttcccgcgcaggtaactccatgcaccttgaagtttcacctcatgcgttgagtgtccacgaccctcgatcccctccgctttcggaaccctagaaacccatctccactttgattccgtcggtttcgttgcttatgtggttcgatccgtcagccggttctagttgaggaaccgtaggaaagctcatctcgtgacgggatgtgatttttttttcttttttgggcggctctcgattagggctacttttggttgggctatttttggtttgtgcgcaagggtatgaaattggatgttgttagttctgtgttgctgtcctgtggagaatctgtgatgcttcactttaagcgatatatgttctttttaactcatactccctctggcccaaaataagtgcagttttagcactgttcatatccaacgattgaccgttcgtcttatttgaaaaaagattatgattagtatttttattgttattagatgataaaacatgaatagtactttatgtgtgactatttttttaaatattttttataaaattttcaaataagacggatggtcaaaacgccgagcacgcatatttatggctgcacttattttgggacggaggtagtactgattaaacctgaaaggtccgaggttgggttaaggattactgcaataggtaagaatctccaaagtcgatactgtggactattatggctgtttcatgttgtgtcgatcagcttcagatttctgacacctagctctttactactatgtggatgaaatgaattcagaactgcactcttagtaaaaagcttgaaaagcttcttgaattagcttgtagcaagtcatagtttatggtctgaaggtgtaacatttatcttttggtcctcttgcattcatgtagaaatatatttagggaagagctataattggttcctttcttacttcagggatttgttcacgatggcccgcttgtatgttggcaacttggatccccgagtgacttccggggaacttgaagatgagtttcgtgtgtttggagttctgcgaaggtcagtttctgcctaggcaatttttccacttcatctaattgggtgtttggtttttgcattgtgctgcattagtcttgtgtagtttttggatagactagttcattaattgtgtgccggaagggtaatagttcatcccagctgtgcataatgccataactgacttgtgcatattcatgcaactatattctgcttgcattataacatcagtcttatggtattttagtgacagaagttcattaatcgtgtaccaggaggaaaatagtgcatcccatgatagtcctacgtttggattgatgatatgtgttgttttaagtgtgacagaactctatgtccttttaccttttttttaataaaaaattcttagctaattggatggccatctattcctgactcaatatagtggtaccccttgtactataagttatttggacgttgcgggtatgtttgttgatgtaattttcaagtgtatttttccatgcagtgtctgggttgcccgtaaaccacctggttttgcatttatcgattttgatgacaagagggatgctgaggatgcactccgtgatttagatggtatgtaacggtgttttttctgcacactgtctgaagtttgtcagaaaattcttttgttctattttgatgaccttttatatgtcaaattagcaatacaggtagacttcttgtcctttttgctctttttgaatcaagctttgagttaggggtgggcattaaaaccgataaccgaagaccaaacccgaaaaaaccgaaaccgaacccgaaaagactgaactctcgggcatcggtcatttgttcgggtgtgacatctgaaagaccgaacaaacttcgaaagattcggtcatcgtgcaatactacccgaagaaaccgaggaccgaagaaaccaaatcaatacaatcactaagcagacaacgtgaccatcctatggaccaaaacagcccaacaacaaggtgaggcccaaatccacgtcaatgacccaatccccatgaccccaccattccattgaccgaagcactcctaaccctagttaggccacgcgccgccggcgcaccacttatctcgtcgcatcgcatgtccccttccttccacgccgccatcttctgcagtgctgccgcatgctgctgctcgccggcgtcgccgcagtgtcgcatgcaatcgtgtggtcacgtggaagccataaggaggccacaggctgctggcttgctgatcctgctgcacagccgcatgccggccgctgcgccatcgcgtgccgtctgcgtcgcgcggctgatttctgccgcgtcgtcgccttccgtcccgccagcacttgtcaccatgctagtggatatccgtcccatgtgactgaggtggagccatggaggttttcaggagcaagaagacgagaagattgaagaggacgcacgttctggttcgggcacctcggtttagaccgaagaccgaaccgaattttcggttaaccgaagtagcggttagtaatttttgcttaacaacttcggtttcctgtttccaaagaccgaatttttaaaagaccgaactaaccggaccgaaatttcggtctagaccgaatgcccacccctgctttgagtggccaggaaattttatctgtttgacaatgtctcttatctcgagttcttgaatttcttttatcctattgtattaaaatgcatcctgaccaatcatcttcataggttgtgcaagctttgtccctgtgtagttagaattaatttatgcattatcaggatttgttcaaatgcgtggttcctcttttaataggcaagaatggatggagagttgagctctcacggaactcaagtagccgcggaggtcgtgatcgacatggtgggtctgagatgaagtgctatgagtgtggtgaaactgggcactttgctcgtgaatgtcgtttgcgtattggtcctggaggtctgggtagtggaaagcgtcgtagcaggagtcgcagccgcagtcgcagccctcaataccgcaagagcccgacctatggtagaaggtaactttatagtgctcaatgttgtatataaatatagtagtatggttagtttggtgtcaactttattttccatgcccaatttttttttgatattttgtgttaaaggtggggacttacacatcaataactcttgtctcataatacgcttcgcgtgatccactttttacttgcagttaatccacttgttctattaaacacctactttgttgttgaatttattgtaatatatgatgtaaaagaaaggaactgagctaattattctgcgaacagaagctacagtcctcgtgatcgctctccaaggcgccgcagtgtttcaccagttcgtgggcgcagctacagcaggtcaccacgtggccgaggtggttctccttatgctgatgggtaaggcatattttgttaattttacaattctcgtcttgtatggctttataaatcatatattctttatcattcttatgcatgcctgcttttcaccttttttccagaagagatggtggcaggtaccgccgtagcaggagctagaccctgatgcctgtgcttgaccgtctgctctttggcttgcatgccatgaatgctttaagactggcatcaactgattgacttcaattaaggtttactactttatctgccttgatatttcagcctcttatttctgacgttaaaaaacttatgggatggatgtaatatgcaactaagacatattacctttctactatgtgctaaagagggatcattctgcttaagcgactcagccaactaccggctctgtctgcatggttttgttctgcactcttcattcctcgagcgtgttgcctgcttcatgtgaagttgcaagcaaaagagaatcttccattgtttcctgcctatgatgcctcgttgtggttggcactcttcgttgaagatgctgcatcgtcacaaattagtaacatatttcctctcataaaattgataacattttgagcaatactaactagtgattagtgcagctcgtgcaagtaaatagaccatttttttaatagaaccatgcatcaagagattgatacagcaaaataaatcttcatgtcagtcgttgggttaaaacatcgcattcatctgcagcctgtaattcagcgacaaaaggaatttgctgggttggcttccgcaagaggcagagactaccttttaagcggttccaccgactccaccccttggctttattctttctggtttttccttcactctgcgcatctgtcggccttcttcctgcactgcatcgccataatagtagcctctatatatgggaccttcagatgaaatattctcgttctgcattcttcctaccggcggccattagacaaaatatgttttttttttctttctgtttatgtggtttattacttttatttgtatctcaaccgttcagaacaagtggccagcacttcatgtctcaattgttgtgaattactcttttgacctagagctaataacagcctcagttcatatccatttcatatttatgtgctgtacgtcactcatctaatatatctgtactaagtatatgttgcttgtctggttctggaaccgtagagatccataccataaattagggtctgtttggggagcttatctgagaagcaactggttggtagccaatttctcagaatctgggaagctttgtttcccagtttctggtttctagtttattttctagattctataactatagcttctcagaatctggatcaaaaactagagaagctgtagcatcccctaccactagatgttgtgaaattcccatgttcggtgtgttccgtcctctctagtgattatatttttcctataacaaagttagctcaaaataagccaaagaaatgtttcctggaagagatttggatgtgagtttgctgttcctgagtcagttatggacgtatggtatagttaatcggagttcttgctgataactgtctgtgcttgcttccttttatttctttctttggtcaaatatgatattctgagatacctctcgcgtaaccaaatagatgtgttaacaatacaacacttgggatatttcctcaagaagaggtaaaccctggtcggatttttttcatatccattataatttcttgcacgggcacaccacacgatagcgcacgcccacatgttctctaccctggcctctatcacggctctaatcagagttgcttttttttcgtatcaactactagtatcaggctgatactagtagttgatacgtttagcaaacgaagagatgctgtctagttgcagataaatcaaattaatctagtgaaggttggcgtgcaaatatgttaaagcagtcgtgctcttgtgctagtgactgtcagatgacgcgcttcttcgtaaacacaatttactctactcccctcatcacagtgtctatctgtcacaagatgctcgcctgaatatccaatcagcaaccaggcaacctcactgccaaatgaactagataacaagagatcgatttctaaacagaaccaacgagtgtgttcagtatgctactgcgccagatgacgattcgttgatttgtagtactccctccgtcccataatacaagggattttaagtttttgtttgtactatttgattactcgtcttattcaaaaaattttagaattattattttttttgacttgctttattatctaaagtactttaagcataacttttcgtcgtttatatttgcataaattttttgagtggtcaaacagtgcaagcaaaaatttaaaatcccttatattatgggacggagtgagtaatagagtaagtagtggagtagtactcccttcattcctaaggtggagagggattaaactttagttcctaattcctaaacaccacctaaatgatctacctatttcaccagcaaaagcaaggagcagttactaccccatcgatcaacataactttgtatgcagtgctgcttaatacgaagtgccgtccatgatttctgccgcttcctaacaaaatac

SEQ ID NO: 69599 - DNA, 16172 bp, Oryza sativa
ttgctatgcggtttagcgtgtcacgctcggtccaacggatcgatcgatcatgcgcttttcgtcatccaaaatcattacgatttagacgagcaacaatgcaacactagtagtagtccttgactccttgcagtactaagagcacccgcaatggtaaagtaagatgttctctataaaacatgtacatctcagcaatagactagattaaagtaaactacctcaatagtatgtctatatgggtatctataactctctaatgcattgcctcgttttttctctatagactatctccaggttagtagatagctttgctctctcttcatttaatctttttcaagtaggaaaatatgctgacatggatctcttgtagagagcctatagataatcattgcgggtgccctaatgaaacggaatctggtcccttttgctgccctttctgggacgcaccacggcagaaaaaagggtcaaaagagccgcgggcatcatgcagtagtactaagcagcacaaacctgtgtctgtgtttgtccgtccattcgctttcgttgacctctagctctaatcaagccattttgcggtgaccacttggggagttggggacaaatagctactgcccctccatttcaggttataagatattttgactatgtacaaaattgaactgttttaagtttgactatgtttatagacaaatatagtaatatttataatactaaattagtttcatcaaatcaataattaaatatattttcataataattcttcttgggttaaaattgttactatttttctctacaaacttaatcaaatttaaagcactttcgtcttataccctaacctgaaacgcagggagtactaggcaagtgtgcagcagcatcgcatatgccagatggttaatgccacaccatttgcctgcagcagctcggctggaacgtgccagcgatctagagatggcaagacaaccaaccaaacaatggcacctcagtcacctcacggctttcctctgacagatgtcgtcattgggggtccaaaccgttagcctcgacatgtcgccacccgttgtttccacggccttttctgctctttttttcttcagccaggacctgatggatgctgatgactttcgcctagtactagtaacagtcttgtctactactactacacattcaaagtgttcttttcccggtcagttaaatcatttcggatcagaaaaaaaaactcattttatttctcatacccttcttcccctcgacgaccacctaccacccaccttctcatctctcccttctgataatcgccaaagaagagagaaaaagaaaaaaaaagaatctgaacaactctcgcttgcttaccattaaccacagtaacaagtgcaccactaacccccaaagccatcgattagcggcgactaataaagtaattaagcccaaggtggggagcatccacggggaggagtttctgcttcctccaggctctacgagtgcataaggtggagtagtactcccttcattcctaaggtggagagggattaaactttagtccctcgttcccaaacaccacctaaatgatctacctatttcaccagcaaaagcaaggagcagttactaccccatcgatcaacataactttgtatgcagtgctgcttaatacgaagcgccgtccatgatttctgccgcttcctaacgaaatacgatgatcaaattggaacttttatttttggtaatacgaagatcatttaggaatggagggagtactagtttgtaccagatgacgattcgttagttggttttgaacattgtttaaccgccagcacgggacgagcgaatcgagctgcctccgagtgcataaacaacaagcagagtcgcccactcgccaccgccaagtccagtttctctattccccagctgtcgcgcgcacgaggcgccggtggggatcccgaggaaggagagcacgtcacgactcacgacgtggacgcgcgtgagatccctccattctttttgtgactcgtaggtggacttcccctcgtgcgcccgcgcgccaggaacgcgcatagccgcagatggccgcgccgcgtcctcggctcggcaatttgctcgcgatcgccatcacccctcccgtccgtgcgtccgcgggaaacttcccttgcgaatcgcgtgcccgtccgtcctccgcccgcggccccgcccgcccgtgtgtggcgccgcgcgttttctgcgcacgcgcgaggcgtttgctgcagcgacagtgcacagcgctcggagacgccgacgtaggtagttgtatactaccatgaaggcactgcttgtaaatatctgagtgactgtgtctatggcatctgcttttgctatgcggtttagcgtgtcacgctcggtccaacggatcgatcgatcatgcgcttttcgtcatccaaaatcattacgatttagacgagcaacaatgcaacactagtagtagtccttgactccttgcagtactaagagcacccgcaatggtaaagtaagatgttctctataaaacatgtacatctcagcaatagactagattaaagtaaactacctcaatagtatgtctatatgggtatctataactctctaatgcattgcctcgtttttttttctataaactatctccaggttagtagatagctttgctctctcttcatttaatctctttcaagtaggaaaatatgctgacatggatctcttgtagagagcctatagataatcattgcgggtgccctaatgaaacggaatctggtcctttttgctgcccttcctgggacgcaccacggcagaaaaaagggtcaaaagagccgcgggcatcatgcagtagtactaagcagcacaaacctgtgtctgtgtttgtccgtccattcgctttgcacaaacctgtgtctgtgtttgtccgtccattcgctttcgttgacctctagctctaatcaagccattttgcggtgaccactcggggagttggggacaaatagctactgcccctctatttcaggttataagatattttgactatggttaaaattgaactgttttaagtttgactatgtttatagacaaatatagtaatatttataatactaaattagtttcatcaaatcaataattaaatatattttcataataattcttcttgggttaaaattgttactatttttctctacaaacttaatcaaatttaaagcactttcgtcttataccctaacctgaaacgcagggagtactaggcaagtgtgcagcagcatcgcatatgccagatggttaatgccacaccatttgcctgcagcagctcggctgaaacatgccagcgatctagagatggcaagacaaccaaccaaacaatagcacctcagtcacctcacggctttcctctgacagatgccgtcattgggggtccaaaccgttagcctcaacatgtcgccacccgttgtttccacggccttttctgctctttttttcttcagccaggacctgatggatgctgatgactttcgcctagtactatttatagtcttgtctactactactacacattcaaagtgttctttttccggtcagttaaatcatttcggatcagaaaaaaaactcattttatttctcatacccttcttcgcctcgacgaccacctaccacccaccttctcatctctcccttctgataatcgccaaagaagaaagaaaaagaaaaaaaaagaatctgaacaactctcgcttgcttaccattaaccacagtaacaagtgcaccactaacccccaaagccatcgattagcggcgactaataaagtaattaagcccaaggtggggagcatccacggggaggagtttctgcttcctccaggctctacgatccccaccgctgcgctgaccaccctcctcgtgccgatgctgcgcagaagatcggtctttggccgcctccccgccagattcggccggtgaagctgccaaggctgctgcgcggtgtggttgacgagttcttgctcgctgactcgctgtagctgatgccatgtttggggcggggaaggtggacgatgagatggcgctcaagaggcagagaaccgtgaggtgagcctgcacgagcaaagcaaaagctcttctttggtctagttttagcttttcagctcttagagatccaacaggctctgcgacctgcgagtgatttggcatttgctgtgagctttttcttgttgttctaggaggaaggacgctttagcctggattgtgccagctttctaatttcctgttactctgcaaacaatttatgtatttgacctgttttttagagcatagactccttttaagaacccaaattaatccattcgatttattctatagcatggtatgatgaaggttttcatcccttttagttgatctggccaggaaagattaacctttcgtggataagaaatatagggcttcaaccaaaattgatattagaattaaattgtgttaatgtacaaaaactgttctaactgtcagttctttatgtgatttagtttacaatgggaggttctatttcattcccaacattatttttcttattttcactgttttggatggacatacgaaaatattcatgatgtagagttcaaacatttatgtgaggctgtaattcacaggttctatgatgagaaggcaaaaccaactataccaactcaccagaaacaggcagggttcgctgctagtaaacttggtgtggcaagctcaggaaagaacaaaatttttgtgccaggagaagagctgtggtacaaaaggattttggacccatcaagtgacttcatcttgacatggaaccacattttccttttttcgtgcttcgttgctctatttatagaccctctgtacttctacgtgccaaaaatctcctatggcaccccaaattcgtgtattgggacagacaggcatttagccatcactgttacattcttccgatcaatctctgatttactatatttcactcacattataataaagtttagaacggcatatattaatccgagctcaaccatgagggtatttggaagaggagaccttatcacggatccaaaggaaattgcgtggcaatatttgagatctgacttcgtagtcgatgcagtggctgcattgcctttaccacaggtaacttggcgctcttccttttattcttgtcaactggagtataaccagtattaatgatcattattgttaggtcgttttcataactgagtatatttgttagctctgatgttgtcttatgttcatttatctgcatgcggacataaatatgctactgtgctaatatcaatcgtgaagttctattgtggatcacctcaattaagtttctttacagcagatgctactatagtatcttgtggataaataatgatttgtaactgtgttagtgctgcccagaccacactaaggacaaaataattttcccctcgcttaatacaaaagatacgcatgttctgcgtattctcaaaaaaaaaaaaaagtgtcacttgctcaatcatcctgtctctaagtcagcatgaaaatcctagggaatcatcatgttcaatcttggcaaatattcttcatagtttaagagccaatcactaaactgaaacattttcatatgatgcattatgaatttaataactattattttaccatcagtgccgaccacatgtattgtctcttgatttttcttgtgaattcctgtaagctaaaattgaacctcatattaatgttccactggataagtttactacaatgggctccaaaatgcagcaacctgccatagcatctccagtttgtttgagctgattttcaatggttataatcttactcatcgggatttctaggttctctatgcttcatagggcaattttgtacatcgtcaaacctaaaagcactaaataactgaattttatttgtgcagctgtttatattgctctttccttcaaatggaggaatcttcgattttgactttgcctgctgcttatgtatctttacatttatgcagatcttaatctggtttgtgataccagctattaagtattccactgatgagcataacaacaatattctggtgctgatagttcttgctcagtattttccaagactatacctcatattccccttgacttatgaaattgtcaaaactactggagttgtcgcaaagactgcttggcaaggggctgcatacaatatgttgctttacatgatagccagtcatgtatggtattcgtaagcgtttacatgaaatgttttctacatctcaaatattggtgttcagcaaatgtcgaattagatgtatttgcaagtctttaactccatagctataatgtctccaaattttcacgatctccattcatcttctttcaggtactaggtgctctatggtatttgctatctgtcgatcgccaaactgcctgctggaagagcaattgcaagaatgaaactggctgtgatattaaatttctagattgtgatgtgataccaaatcaaaactgggcaagcaaaactgctatcttcaatacctgtgacgcaactaacacttcaatcagttttgattatggcatgtttcagcctgcattgtttaatcaagccccagggcaacgtttcttgatgaagtatttctattccctttggtggggtttgcagaatctgaggtatttccttgtcaaaacatcttcgtgtcaaactacagcgctataagaaggaacttagtttacagtttccttgtgaaatgtgtgtgttcagaaatttcatgggaatcacggagatttttgtgtcaagcaaagcagtaaattaaatatggaagtttagcctagttcttttaatgggatcattactttaccaattttcaagatctatattcattttctaacgagctatatcctcctcttcctttgcaacagttgctatggccagactattactgtgagtacctatattggtgagactctatactgtatattcttggcagtacttggtctcgtcttgtttgcacatttgattggaaatgtacaggtaatttttaaatgtttagtgatcatgtctacactacgattgattcttttggcacttttttatacactgctactatttttccagacctacttgcaatctatcactgtgagggttgaggaatggagattaaaacaaagagatacagaggagtggatgaggcatcgtcaactcccacatgaactacgagaaagggtgagacggtttatccagtacaagtggctcgcaactcgaggagtgaatgaagaatcaatattacaggctcttcctgcagatcttcgtcgtgacattaaacgtcacctttgcttgggtcttgttcgccgggtaaatacttttgcatgcttttataaaatacacccaagtaaatatttgaaactgttgtgcgatcttttgatgtttttcttttaagcaatgaatggtactagaaagttattgtatatactggtcctcttctcttttaaaagattattagagtatatagttagttttagtgctgttttggtctcagtatatacctggagtttctcatgtactcactaaatttgccccttgacctacctcatcaatggaatatttactggttgcaattacttgattccttcatttatattagaattgatcttagcatcatatttggcaatgtcacaatgaactagaagtgattggattcttatatagcagcagtaactatttgatcctagttaagctagtggtgccgggttttgacaatagatggcccttgatcctaattaagtgtagaaataggcagtctgagattgttagtttgcatagttaccgcagggtccaaatattctggagattccaaacaactattttgaaactgtccaaatatacacttcttttttttaaaaaaatgcatttcttgggcaatttacactacaggtttgccttatacttgaccggtgtgctaattttgtctttacctaccacaatatttcaggttcctttcttctcccagatggacaatcaacttttggacgccatctgtgagcgtcttgtatcatcgttgtgcacacagggcacatacattgtccgtgagggtgatccagtgaccgagatgctcttcatcattcgtgggaaactcgaaagctctacaacaaatggtggccgcactggcttcttcaattcaactaccctgaaatccggtgatttctgcggcgaggaactgcttgggtgggctcttgtccccaaacctactgttaatttgccgtcatccactcggacagtgaaggcactcatagaagttgaggcattcgcactccaagctgaggatctcaagtttgttgcaaaccaattcaggcgtctgcacagcaaaagattgcaacacactttccggtactactcgcaccactggagaacttgggcctcatgcttcatccaagctgcttggcggcgatacaagaggaggaagatggcaagggacctgagcatgagggagtcattctgctccatgagatcagatgactcaaatggtgaagatgactcgccacctaagcagaatctcgctatgaagatcatgagtgggagtaggaaaggacctcagaacatgaaagagttgcctaagctaagaaagccggatgagccagatttttcagctgaaccctgtgagtaaggtctaaaatgcaacagccattgcttctgctaactctgctgctaccagttaaccattgctatactaccatatactgttggatcgacggcacgagttgtccaattgttgatgagaaagttcattaacttggaaactaaaaaacatggagaagcagcgaattcacgaagggatcgaggctttgagttgactagatgttttaggcgttggcaacttgtacatccagatatacacgtctgtgcttgtaacattcttgagatcttagaaacggccgcacccttacatttgactgcagagaaagagcgtaaaagaactgaagaaagatcaaacgtaaaggcagtctgtatttttgggagtctgtaaagcgttagggcggctattttttgcttttaactgatagacatttcgttgtattgtgcaatgtatttttgtggccaaaactgcaggttaacatctatactgtgcatacgttgtgcctcctttgtggctctctctcttgaacatatatactgtgctgtggtctgtggaatgaggagctgttccatttggtaacaaaccatggatacaatcagctgggctgcgtatcaaatatccgttgctacaagaaatttgataatttggcacttttatcgttgtcgacttgctttaattggtaatttttgagagtgacttgtgagatcatagtaaataaatgtagattaggatattaaatatttttttcttttttttaaggccaaggggaccatccaaatatattaagaaggaataaagtaaaaaaaatgacagaaaccacatgctaaccacgtaagcactaaaacgaccctgctatgcgtagtcgatcgtcgccaggtttacgacagcatcacaagaagagactctgaaaacggaagtgtcaaattatcaaatctccatacaagcgtggcacgcagggtggcggccggcgggtaggggagggatatgcatgtgggactgtgggcgactcatcagccgtcgctcgtggagaggcgccccacgcgcgcgcatggtgcgatgcgctcgttctttcgcgcaagctgtgcacgcggcgcggcggcctgggcaggacggtgccgctagttcacggggtggttcgcggctagcccaggtgaatcgcgggccgcggctctgcaggatcgatggcgccgccgccacgtgatggcccacgatacgatgatatgcaagcgtgtgtgtggcccaatccggcgccgcctcgatcagcctcgcgcctgtacacgttgccggtcgctgtgctgcgccctgccagcgcgcggcgcctcggacgaacgacgtcgttgttacgctacgcacgctagctgcttgggcttggccagccgtctgcttcgccggcctttatcccagcacgctattcctcccctgcatcacacgctacttgtacggataattgagtcctactactatagtttcccaacccctcttctcgtttttcacgtgcatgtttttcaaactactaaatagtgtgcttttttaaaaaagtttttatatgaaagttgtttaaaaataatcaaattaatccattttttaaaaaagttaacaaatacttaattaatcacgtgttaatggatagctccgtttttcatgcatgggagatggttcccaacacccacctccgaacacacccttaactcgtactacaatattaccaaacggataaacttttctttagataatggaatgaaatagcatcccggcctttactcgaaagagctacagctaattattacaaactagctgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaatatgaatcatagcaatccttaaaataaatagatgacttatttaccttaacttaggttgcagctcagacagcccgagaatacaaccgacgacacggacgaggcgaacaccaacaacaacagcagcagcggaaccaacggtctaacacccaacaccacaggcgacggctgggaaccaggacgaaaccctaatcttcacttcactttatcttctcttcagggcggaggaactatatatatatatatttatatagagcaagggtgagtactttcgtactcagcaagtcacgggaacttaggtgtttaatgcaagcttggaagagaggcaaggtcgttttgcaaatcttttatttgaagactttttgaaatcactaagtgatttatttctttctaagtttgggccgaaaagagacttgcgtctcgattcgactttaagagatgtttttcaacagctcatttagtaatgtaccgacctcccgggtcagatcattacttctcggctcccagagccattccacttgattaatcggctcccagagcctttttcattttcttggactcccagagtccagctgcccagcagcaaagcaatccgcttccactcgggaagcctagtctatgatgcccacggacatcccgaatcacacagattcgtttctgaccactcaggtcatccatctgccacataggctgattctggttacgattcccacaccacaataacttttcacaaagcacaggcaaacaaatctacgcaatgggaaccacctcacatccgcccatgactgtgggcacggctgttcgaacagttagttaacctctgcagaggggtacactttacccacaagacacgaacttactctagacactggccggtgtcagaggttcgcgacaaagcctttcccaagccgacccagggatacctcatgccacatagaaggatcaaatcctcacataaacataggccattttaggcgttcacaaatcaaaccccaaccacctcgatcggtaattcagcaagcttctcgttcttgcattaccaggaacccggtttggctccaaccgaccccgtcccggcgttcccaactattggcatgcgaggtttccctgaaccgactagttacttggccagggtgtcccattccaccttgtggttgcactttgattatgttcgatgagtttcccacaggaatcggtccttatatgcgaatacgggacagtgccacataggcacaacccccgcatcgcaagttttcacaattcattttattttcaaacacaccgacaccacatgtcgggttttgaaggcttctcaaacccattccccaagttttcgacaaacagcggtgtatgtgggatatttggtatacgcgctcagagaacacgaataccgaggtaccacaagggtggagcgacaaggaatcagggtagtacgacctacgggaattagtgcgactactgggtaggtccgtcggtttggcacgcaaaccgaggccaagcaagttaagtgtgtgattctaataatgcaagttgcaaacaaaataataatgactttttagttataggggcaattgatcaaagggtgaattgccttgctcaaagtcttcacgaagcttcacgaatcttcaagaaaacccgcgatcgacgaaaatccggtaaccgcaactatacgcaaacaatcgaaaacctaaacaaaagaccaaaagaaagatcctatttagactaattagtagtgccattaaatagatctcaattttatgggaatactggaagttgagcggagtcaatcggagttgcgaattgggtgatatgaattttggaagtttaattggagtttctggaataggagaaatggtttatggaatttgtagaaataatattctcaagaatattattgacagtcactgtcatgcgggaccaaaggaaatggtttatggaattttggaataaggaattgatttatgggacaaaggaaaaaggatttattaaatccctggaaaaagaaaaggatggagggatgttaattggacttgggccgagcgaaggggcgcggcccgaagagatgcgcgggcgcggccgaggcgagcgggccggcgcgcgggagggaggcggcccaaggccgaacgaggcgcggcccacgcgacgcaagccgatggacgcggtccaccgagtcgggcgcgaggcgggacccacaaggcgacgacacggctcacgcgagcggggtgcacgcaaggcggcgcgttggatcggtggaccgggagacctttgaccggtctccgcggggccgggcaggtagatgtggcgtcctcgtggacagccacgttggcacgggcgagggaggaggccgggcggctcattggacggcccacggcgcgcggcgggatccggcgaacggcggcgagccggaaggggcggctagcactggcggcaggaggaggagaaggggaactcattccacggctcggatcaggaagaggacgcgcgacgacggccggcggcggcggccaatctcgccggcacgccgacgtggccgcgcgcgagaagagcgaagggtgcgcgggctcgggcttagccgaaccggtatggtgttgcgacgcgcacgcggtgacgcgggacccgatggtcaccggcggcgcacgcacggcagcgttatgcggcggcggaagcggcgacacggcgcggagacaagggagaagaccgacggccttggggcagccagggggaggtcaaggggatccccgggagcgtggcagcgagaggaatcgacgggagaggagccgacgacgatggattgcggcgcggcaaccaccggagagcaaaaaggggaaaacacgacgagacgacgagggttcgattcaaaggggtgggagcatctccggggttcaaggaatccgtttccggcgtcggattggacggagcggcaccgagattggctggcgacgagaggcggcctccgggacagagcaagagcgcatggcgagctatggcgagcggcggcgggcgcggcgcatcgcacggcaggaggaggattatggtggggagctcaccaacgaagaggaggcagcgttggcggcgcggtcggtgtcgcggcgaggtggtcgcgacgccgaggcggcacggcactgagagggcgcggccggggaagaagggagggagaggtggtgcccggagctcctcgtcacgcgtccacgcacgcaccggctcctccggtgctcggcaacggacgacaacggcgagagcgggacgagcagcaacaaggcggcgacggtggttcggcggcaatggcgcggtgggtgtgaggactgaggcgagtgaaaacgagagaggaaggggtttggggtggcttggttttatagcggaggtgaggtcggtttggggaggggagaactgaccttggcggtcaaggggagctcggctggcggcagcggcggtttcgtggacgatgcgaaagcggcgacggcgtggatgctttgggcgacgaaggcggtggatcgagcggcggagatcgaaccgctggagcgcgggctggcgtggtcaagtagatgaggcgggtggcgcgagcggtcaagcggcgcagaggtggtgacgccggcagtggtcgggaaagggaaaaagaaggggaaaaaggggcttggtctcttgccataatgaggagagggagagtgaggaggaggaggagagggagagcagctgcttctcccactcttggacgggtgcggcgtggagtggcgggggggccatggatgacgtcgacgatgacggcggcggtcggtttggcatggagcgggggcaaggcggcagcgcatggcgtcggcagcgaccggccggtcggccacctcgcgaggcgcgcgcggtaatgggcgaaggcggtggaggttttgggcggcgacggcgggaagcggtgtcggcgcgagagtgaaaccgagagggagagagaaaacgagagagagagaaggaagacgagagagcgagagaaacagagagagcgagcgacggctctctctctcggctcgcatgcgtgcaacgcacgtgcgagggggaaagatgatgggctgggaggggagatgggccgggggagaaaatcggtccatccaaaaatacagggaggtaaagtagacttttacagagaaaaccgatttggatagaattgtagatatttagggtttggattcgaattcaaatttgacattcgaacttgagggtttagggatgtatcaagggaaactcaaggagaagtcatggaaaagattcaaaaggaatacttgggtatttgttctcgggaacatagggtggagtcaaggaaaggattcgaggcgggatttgaataattctggattcgtagaagtatttggtgaggattcaaaggaaggatttgaatttcagaatttgatttcagagactcgaatcggaagaggaattttcgaggtggaggattttgatttcgatgagagggaacaacgggattaaattgagatccctggcacaacttagactctcacacaaagaacgaaaattttcgtaattaggattttgccgagttagtttttaacgactcacgaaaagcggagcgttacactagcactctgtaagagtgaagttcaaatagaagcaaacacaccaaccaaactagacaaaataacattattccagtctattggtaaatctccatccatgattggcaaacagttgcataaccgtcgtttcaaccttacgacatgcaacaattaagaaatctgcatcttcatcacacttttgtaactgtgcccacagacgaagccaatatgttgccttgaaaatgacctgcatataagtaatagtaggtgatttgtcaaaaaccctatcattcctactcagccacagtgcccaacacaaggcagaagctccaacaagtatcagtttgctctttttgtttatgactccctgaagccaatcatcaaaaatatgagatatgctagtaggaatatataaaccaaaagaaaactgaactgccctccaaataaactttgcaaaatgataatcaatgaacagatgttggatagtctcattttcgtacaaaagcaacatcttaaattaccagtccaattccgtcttgctaaattatccttggttaacacaactcccttaagcaaataccacataaagatcttgatcttaagcggcatcttgagtttccaaattaacttatttctgtcaatgtaaccattattaattaaggctaagtacattgatctaactgagaattggccattctgatgatagttccatctaaaataatcaaaagtattattcaattgaatatgaacaatagatgcacacaattcatgccaaagtgttaaattttgaccaactaaagctctcctaaaagaaacattgagcggaacagaagccatcacactagcaacagaagaacttctccttctgacaatagcatataaagatggatacttttctctaaaggccgtatttcctaaccatctatcttcccaaagtcttatgtgttccccattattcacaatccaagaacccatagttaagaaagttttttttgactttcatgagtcctgaccaaaaatgggagtcaccttgtttcctgtcaacttgggtgatagacttattataaagatactttctcttcaataagtct

SEQ ID NO: 69600 - DNA, 8910 bp, Oryza sativa
gaattcctgcagcccttgaaaggacagaattaatcaaaaccagtctacccccaacagacatatgttttcctttccagctgctgagttttttctctattctttgatcgataactttccaatcattattacatagctttctaaaatgcattggaataccgagatatttaactgaaaaagaccctaacttacaaccaaagatattagaatattgcttataacactcctttgcctgaccaaagcaaaataactcacttttgtgaaaattaattttcaagccagataatttctcaaagatagacaaaatcaattttaaattctttgcttgttgtaaatcatgctctaaaaaaatgatggtatcatctgcatattgcaaaatagacaaaccatcatccactaggtgagaaaccaccccatgaagagatccattatatttagctcttttaattagtaaagctagcatatcagcaactaaattaaagagaattggagatagaggatccccttgtctaagccctttatgcgtttgaaaattattaccagtttgatcattcactttaataccaacatgaccaccttgaataaaagaggcaatccactcacaccatttaggagagaagcctttcatcctcaaagtctgttgtacaaatgaccatttaaccttatcataagctttctcaaaatcgatcttaaaaattacagcacttttgtttttacgatgtaactcatgcaaagtttcatgcaaaataaccacaccttccataatatttctcccaggaataaaagcagtttgagtaggactaattaccttttgggcaacagtcatgactctatttgtagcaactttggtaaagatcttaaaactaacattaagtaagcaaataggcctatattgctggattgtcatggcctcaacacacttatgtaaaagaatgatcgtaccaaaattaagagagtataaaggtaaagtaccattatgaaattctttaaaaagatctaataagtcacattttataacattccagaaaacttgataaaattcagcaggaaatccatcaggatccggtgctttgttatgttccatttggaagatcgcctccttaatctctttttcagtaaaaacctgcgttaaagcctcattctccaattgagaaacttgaggaatgtcagcaaatttattctcatcaaactgaagagtagaatcatcaggaggcccaaataaacctttataataagtggtaatatgcgatttcaaatttgcatcaccatttattaattggtcaccatcatgtaattgaaaaattctagtctttctatgttttccatttgcaaccaaatgaaaatattttgtgttagaatcaccctctaaaatatccttagatttcgccctctgataccatttaacttcctcttctctcagaattgtagataatctatttctacaaaaccatctaaaatccaattactcctgactcaaaagcatagtttctgcctttttatctagcaaatccaacttatctaaaatctccttttttttcttttttgtacaagccactagtatgtttagaccaacccctaagatgctgtcttaaacgacgaattttcgcctgccaccgctccatggcagaattgccttcatcaacactagaccatatctcctttaccatatcaacaaagccatcacgtaaaagccaaccaagttcaaacttgaaactatgttgagcattactcaaagaagaagtgtttgtatttaaaagtaaaggagtatgatcagaaatatctctattaagagccaccacagaagataaaggaaatttatgttcccactccgtggacattaaaaccctatcaagtttctcatatgttggattcgctaaattgtttgcccaagtaaatttcctaccagacatctgtaactcccggagacataacccatcaataatagcattaaaaaggaagggccatctatcatcataattatcattattcttttcatcagggctacgtagaatattaaaatcaccaccaataagaattggtaaggtttcatgactgcacatattaactaattcagcaaggaattgatccttaaattcactttgagctggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctaggaggcttgcaatgccacaaaaattctttgccagcacacagatttttaagaatagccggactaaaatctttcttaatagtctctgacaaggcaataaaatcaaggtgatgttcctttgttaaatcagaaataaacttatgttttttcgggtccttaaacccatcacaatttcagaacaaccctttcatttaaaaatattattttttttctttccccttttagtctttttcttactattaggagaggtatctaaagaatttaaagtggtctgagaataattatcatccacagcactaaaatccatcacttcctccattaattcaccacacaaatgttgaagtagagaattatcatccacctgatcatctaatatcttactatcaacatttgaagtatgtacctgattaacagaagaactaacatatttacttaacctcttttcctctatactatttaaatcatttataacatcatctaagataaaattcgtacccaaagtgatcacaccaagattatcaagagcagcagaaatttgttcatttgtaaattgtaaaaaagaaacattatcatgaaagttaccttttgcctgcaagttgtccaaattcttatcagccttcaatttctcagctctttggagaacaagttgatcactgtcacttgcccttctcttgctcttcctggagagagaaattactgcttcaggaatagcagcgagcttttcccctagactttgctgggtattaaccttcttaaccattacagaatcctcatctaagccatcaaattcctcatcagatacattcaagccatcagattcaggtatcagactcaaatgagcagccggtatagaaggaccacccctctcactaacctgaccaccagaacctattaaggaattgttaccaggatcacctccagattccttccccaaatcctggttcagattcccctcctccttctccaaagtcccatcatccagattctccatatccattggtacaggctcgtcagacccattgtcaggctccactataaaagataattcgtacaagtggtccccaataaccacatcaaccacatctgggataaacttaaccgatcggaacttaatttagcttgtggtcaatgctctggtacaaatttctttaccccggagatgtcggccaagagcccaagacgataggcatcgtggttgcgatttgtgaatgactcagcatgagcatcataatcgtggagcaataatccaatgcgaacatgcgtaatgaagactgtacataatcgtcgtctattattatggaacagatcgatcatcgatccatcatcgcaggtggcggtgatctgatcttgccgaacaagcacgcatgccattggctcctaagaagcttttttttttcttttctgcgaacgcgtaaaaaaattacgcattaatatattaaaaaaaaaattatagttacacaacacaatcagccagactgacttataccagaagaaaaactgaagtttaaaaagctactgtagctaaacacaaacttctcccaataagctttctccaccccgatcccgtgtttgcccgttgctgcacacagagattccgcattcggcggcgatgtggtcactgcgatttggcggaagctacccggctgacccgggccggccgatcgatcagctctcgtgccgtcgcgtctccacgtcaccccgattgacaagataacataagatactggattgatattgagtggccatcgcctggagccctgtaacatgtatgattcatgcaaccagccgcatggaacaaacctgcccagctgctgctgctgccgccttgtctcggaactcgatccttggcatcatcgttctttcgccggttgcacggtgagacgatcgttcgcaatattcttcttgctggaaattggacactggacactggcactgcaatttgtgatttggttgtatcagcgagatattttaggctatcttagggcctgtttagttggtgaaatgaaaattttcggatgtcacatcggacgtttgaccggatgtcgaaaggggtttttggacacgaataaaaaaactaatttcatgactcgcctgaaaaccgtgaaacgaatctcttaagcctaattaatccgtcattagaacatgtgggttactgtagcacgtatggctaatcatggcctaattaaacttaaaagattcgtctcgcgatttacatgcaaactgtgcaattagtttttctttttatctatatttaatgtttaatatatatattcaaagattcgacgtgatgtttttaaggaactaaacatgcccttagcctattacttcactgatttgtgcatgtgcagctgattcaaatgtctaccatttgtcgtccagccgaaccctgctagtatggacctccccgggatatttagggcccatcctagtagggactcggtccatccataaaatggtccgtgctctagaaatcactgttgccaaatcagctgatcggtctgcaactgcgctacgataattcagtctccacatggccccacatgtcagccctaaggattagagcatgtacaatagcagactattagctagctacaaacatattttaatgagataaatgatgagagagaagagcagcgtgctataaaactatagccagctgcagcacagactctaagacacaatatatataggataggtgggaccatgtattaataatatagtaagtaattattgtatgaattggatattagattggctatagatgaattggagttagtagtgggctatactattaaacttgctcttaggctgtgtttagtttcacgccaaaattagaaatttgaagaaattaaaacgatgcgatagaaaagtcgaaaatttatgtgtgtaaaaaagttcaatataaaagacaagtttgaagtttgaagaaaaaaaattggaaactaaacgggcccttacacgcccacgcgcccccacaagccgaaaccgcctcaacccaacgtccccaccgcaacctcccccacatgtcagcgtacgtggactggggtccccgtctcaataaacccccgcgcccacgcccacctcgcctcctccgaccaatccgcgcctctgccagcttgtcgcgacgcgcgctcccccgccttcctatttcacccccctcctccgcctccgcgccactccaacccaatcccagccatcaatacctgcctccgcttcgccatctctcccgaagcctcctctctctctctctctccccccgattccaccacacgcaatccaattccaacctcgtgtgcttccacttgtgcgtttcgcccgctgctgtgaacgtactgcgagatggcagcggcggcggcggcggcggaggcgaagcaccggaaggaggaggaggaggacgaggaggagatgacgctggaggacggcgacatcgaggagagcccgcgccgcagcttcgacgacgactacgaggacggcgggagcggcgacgacgaccgggatgacgacggcgaaggtttgggatcgcctcgctcgttccagtcccgccagtggccgcagagctaccggtacgtcgttgcattctccgcttcatcctcctcctcgtttactgcgttgtttttgtttttggtggtggtgatggttcatggtagttctatcgatttcaaccgctgtttgtgaaatctcatgttgatgggtagatttcgttgaattgtactggacggaataacttgtgagtttcgtgatgggactggactgagcgcttgttcggataatactagattgatcgttgacgtgtttggttgggatagttcgggcaaacagttcatgtttgatccgagtggcctggattctagaatttaccagcactcgtagaacatctgattgattcgacagtgctccgacagcacgggtctgaaaccgcaacgtgcgcggtcgcaatcactgttcgatcgcctcctcgctcgtactacagccgtgcagacatcgtttgatctgtctgctgtactgcgttcaattagtgcttagtgggggcggtttgctctggtggggtttctctggcagtttccactgttgcttgtgaaaattgtatgttgacggggacccggttgtgttttcaatttcctgatgattgggatgggatattgttgcgctagttctgatactactaactttgaccattaacactatctaactctgctggtggtaaactgtgcttgctgtgtccccaggttgggatgtggggtggaattcctctcattttgcttaagaaacacagtgctatggtctataaaaaattcacagcctgagtgctgtaatctcctttcctttctcttgttttagcagagtactactgttgcatttctgataatagaaatgggggctttcaagccctagttcaaaaaaaaaaaaacctctgctggtggtaaactattaacgtacaaaatcattttatggctgcactctttgtttgatcgactcctcgtgcagacatcgtttgatttgtgtgctctactgcgccatggttagtggtggtgttgctctgccaattccaactgttgttagtgaaagttctgtgctgatgtggacttggttgctttcattaacactgactctgatcatggtaaactaatatgtacaaaatcatttttgctttgtcgatcaggggattgtttgtactgacacatcgtatagttgtttttggttgtctcaaaaaaattaagacaagggctttgctggcaatctaatacccaagcttgatgaatgccagctgttaaaccacatgttttgttttcttcccaaccgttatgtgcaaacattatgatggtgatatgctgtttgttttgcagagaaacaactgacacctatacaattgctgcatctccgagctttggttacttgggtccctctacaagcaaatactcgatccttgatggtggtcgtagtagtctgggatccgacctgaagttgcccttgttgtctgataagctagatgggaagcaagactctgtcaagagcttgagaaagactcttggttcagcaatagataggaaaagctcgttacttacgcaacatactggagaagtctacatcgctcaaggatgcagtgtgacacagacggtgttcaatggtactatcattaacatgttagattgctcaattacctgcctaagataaaagaaatgcttaatgttttacttgttcttttggtaggggttaatgtacttgctggtgttggacttctttccactccatttacaattcatgaagctggatgggtaggccttgcggtcctagctatgtttgctattgtttgctgttatactggagttctgatgaaacactgttttgagagcaaagatggtatttctacatatccagacattggcgaggctgcttttggaaggattggtcgtctgctgatctctgtaagtcctggtttctttcctatcaagtgaattgtattgcattgcatgcaagattgcatccgaatatctcagcaccaatcaaagtcatttttaataatctgtggattttcattaaattaaaagaatgacaatctgtagaaacttctattcctttttttttttgcaatgtaagaacaaccattgatggtaataaacgaaataattcgtgcaagtgtatcaaagagtaagactaacctggacaatggagacacgaccactgtgcaggctgtattagttttctattttgtataaccttgcttgtatgcgattattgatgatatgatccatgcttatgaaaagcgctctcttaaggttcagtaactggtagaaacacctgcctgctcaagctctggattttctttttccttttctaaaatgctgactcccactaaaaaggagtgcatatggcatatttgtaaactataaaatatggcatttcaatgtttgatacctcatgactgatgaaatgcatattatattgatctttatcagacttttttgtgcaactaattttaacttctggtagagaagaaacaatggctgattctttttctttaatgtttttgcagattatactctatactgagctatatgtaagtagctttcacctggctttatgttgcaaagttttccatctaatcctatatagttcatccccactaagtgtagttaatgctatttctctcttctctcattaaaccacatcacctcaattatttttagcctttagatgatacatctatggttcaaattgtctcttcttcttctctcataaaactatgcaatcttaattatttttaggctcaaaattgtaccaatttgttttagttttgatcatattacatattatttgtacatattatataacttaattttccgtagcaatgcggcggggtattcatctagttatttttattgatcaatccaactgagcactcttttatcttattcaatcctttctaaaaaaaatattatcttatatatgttattcattggatgcagtcatattgtgtggaattcattattttggaaggagataatatgacatcaattttctctcatattggttttgattggcttggcgtccatattgatgggaaacatttctttggagtgttgactgctctaatagtcttgcctacagtatggttgagagatcttcgggttctctcctacctttctggtctcaacactcttaacc

SEQ ID NO: 69601 - DNA, 7809 bp, Oryza sativa
taatatttaccattgaattgtcatgtgtttcaggttatcaaccctttcaccaagtatccttttgaatatcaaaacttgtagtgttctggcttctaggattacattgtgattatttatgtgcctgcctaattattcataggaattgcttcatccttttttttaaaaaaaaatatggcttgatccttaaccacaacagatatgccctgttgttaaacccattggctcggagtttagaggagttgcgccctgaaggatttttgaacgaaacaatctgctctattatactgaggactgcccttgttgcatcaaccgtgtgcattgcgtttcttatgccatttttcggtacgtatacacaattttctggcatatgtacctaattctgcttcatttttcctgaaactctcttagctgcattctctcagaaagaattttttttagtaaattgctcatttaaccacctatattctacttgagttctcaaaacatcatgtacttataagtaccttttgtgcatgacactaaagatgtaagtgactaacctgcgaacccacttataggccaaaataaaccgttggatttgtgggttagccgcttacacctccagacactccctctataattaaaatgttccacaaaactgggttttgatcatttgaagagttagctcgaagaaataccaactttatgcaatttgagatgcgatattttttttcttctaaaccttttttcccatcaaatggtcaaaaactggtgttctgtggagtgtggagtcagtttaggtggttctatgctcaaagattgctaattcctttgtattacgcaacccagtcaaaatatgttgtctaatgtgcaatttactatacttgtttgtcatgttaaatccagttattaaatcaaaaccttcgtttgtgttttcctatgcttttttatctagattttaaaccctttttttaacggaatctagattttaaacttgtcatagcagtaagcttggtaatgtggagtgggcatatcaaatctgtcttgctgcaaacctgcgtatgctctgtatttctgagttgtgccttgcatatttcaggtctcgtgatggctcttattggatctctgttgagtatacttgtggtaactttcttctgctagaatcttgttttcagataaacccttgaacaaggagcaacaaacatactcatttcaacatttttttttatgattacaggccgtcataatgcctgcactgtgcttcttgaagattaggcaaaataaagcaacgactgcccaggtaaaatgcacatcgcgtggtagaccaacaccaaaaatcgctctctttcttttttgtttcttttgtttgtcaactacatccgtggttgacatttttgtttcaatctcaggtcgttgcaagtattggtataataatattgggcaccataagcgctgctcttggaacatattcgtcggtactcagaattgtggagaactactaattacgaaacctagctcgcgtgcagtgcagttcccagcaggtgaggccacaggcatgtcatatctattactcaccccgcttacggttacggcgctcaaaaatggtcaaatatcgtgtgtttatcagaattttgctagaattaccgagttcactgtaattattcgacccaaccatgtaatgcatgtacctgcatagctgcttgcttctcagttccttgaagtggaatatcttcatcacttgcttataccgtgtttctgtcaatcactgttgttaggtctatccagcatgttacttaaaccgcctttagcaattatatgtactcaattaattatagatcgagattgctggatattgagtgttgcaacttgcaacccttgtttccaaggcaccttctgtgtgttttctgatccctctgttgcacagtacgaaattaatgccttgtttggataggacgaaatcccagcccatcacatgtgaatgggcctggattaaggcacaaaatcccagcccatcacatgtggatgggcctggattaaggcccttccaaatgaggcctaaatggtctgggcctttatcttgtttctgcctcttatgttgggctgttcattagtagtagcaaacacaatccaatagcaaggggttatctacaaagtcattaacttatgatggaccgtattgtttttcgtttatcagaaatgggacacaaatcgttgctgaaagaagcttttgcacatgtcacttcagttcagagccccttcttttgtaattggagaatcttttcgttatcatgcaatgcatgcaagtccttgagtggaaaaaaaggcacctaatgcttatgaacacatggaacagtagagaggcagtacagtcataaaattcttttggtactagtacaaagaatgagcaaatgtgttggcagtagaaagcaagggattgttatgcttgactaataaaaagaaaaagggggaagccactgcgaaaaatgctttgaggaacttttcatacaaagccggagtttgccccttttatggggctccaactttcccttggcacctcacatttgtttttaaggaatcctaagtggccaaaaaacccctccctagcaaacagaaagaaggggtgctccctttatgcaaagaggggcatctttgctgcagagtgcatcccacttcgcaattagcccatcttaaaagacaggagctcttttctccttctccccatgacttttagtagtgcaatctttctgccttcaaaagtgactaatcctttctcttcctttcattggtgtctcaaactccctgaccttttcttctttttcacccaaaaaggttatgccttcttttttgctacacgccctcaccatccatactgtgggcctagttgggcatcatgcatgatgctctttgtcaagctctctcctctcaggtgccttcacaccttactttgcttcccatggagagagagattataaaggggatgagatgaggctctcaaagcacaattataaagcttgccaactttgttgttgctaaccattttcaattggttttgtgtgtgtgtgtatttattcctgagctggactgtttcactcatgccacccatggttaaacactgcttcactaaaatatataaaaaaagtactgcctgattaaaggcttgatagagctaatcatgctggttaaaaggtgcaactttaggtgggtgggtggactatgatgcgatttacgcttttactttgcaccaactttgtttcttcaagctaaggattgatacatacacgagcaggggaggcaggcacacaaatcattcctcatgatggtctactttgagttgtgggagatgcatggtaacttaagcaagcgaaaagtgacatgctagccgctttccctcttcctttctccctatgggctaaagaggagggatggggagaagctaaggggaaagctatagcaccaaactttgcttgcatctcatgacatgaatgaattgaatcggtatgatgatttctcaccaccaaagtgccatccaccgaggagtgaagaagaggggaagaaaagaagagcaaaaaaaagcttactacgccccttaaaaagacatgaaaagcctagtgaattatgcgtgtataaaccacgctactagcctcctttgaattattgatgcttacaaggaagaaatcatgcttgcttggttcgattcacttttcacctttctccaataattacgcacgccctctagttcgtctaaaagaaaagataaaggcaaaaaaaaaaaggattactggcattacatgacaagaacactcagctcctgagctccatgatcagtaccttttaaagcaagattaatagtaacgcccacagttggctgcaattttcaccatatcatcaaaagttggtttagtagcttaccagcacaataaacagtctctaacctgtttgtccatcctttcatgacaatagtattttattctttattcatcttattctctctctggagattatttcaccgctgctgatctatggcaccgacggggcccacttttctcgaaaaacgcatgcagccgggcgacagtttagtcgccgactcgccctctctctcctgccttttttctgccaaatcatcgctccagtctacgtggccagtatgtcgctggcataccagctgctattatacctgctcttaaaaatcgatgccattcctaagtttaccttacggtatatatggtaaagatatagaccagatctagggtctgcaatgcatgctctctgaaattaacctcacgcggaatctccacgatactttgtttttaagaattgatctgtgtgcatgcttcatgctttagtagattccttaatcattcatgcatggtttagtgctaatcatatactactactaaactagaggtatagtactacacggtagtttcgtatttacctagttccgtacaaaatttctacaatgcaagacgacgtagaatactgttgtagccttcaacccaacttgaagcccacggacatgcctgcccatccagcttgctattgagtatgggtcccaatgcataaagctgaatgcatgcatggcatggcaacttccttggattttccctcaaaactgtacaataatatagcatatgcagtccccaaaaagaaaaatcagccacatatacatgcacatccaccagatatgcaactattcaagctaaggatgagtcctccatgcatatcatgcatgcatgcatgcatgcatcttcttccaagaactaaagctaaggtagagatcgagaagaaaaaagccaacgcaatcgatgagcttatgtgcgtggacgcgtacccccatcgatcgatcagctgccatagcgcaacccccctcttttctcacccagctagtatttgtggggaaaaagacgtgtcatcatactaacatgatgccgttgcgtgcatatcattcgccgcagatggacaagcagatgcgctcccgctgatcgatcgcagcgtacgcccggaccagcgtgtggggcgcgggcgcgcgatcgacgtgcgtcgcgtcgcgtcgcgatgaggcgtacgtaacgtgatcggtgcgggggccgatgtgcgcaacgtgcgtacgcaaaaaatttggtggagaccgggtgtaatcggtctcacctgcagccccgctccggatggatgccacatggatgacctagggatcgaacggttagctcggcccggctcccggcgctgcgtgacgaggatgcaaatggcttggctccaggcgcagacgcggctttcagcctcgccgacggctcgattcaacgcagatcgcgtctcctcgcctggatatcggctgcatcgacgaccgtctttctgttcccgttccaggcggccgccgccggcgagccgcagcgccaggcaattgatcccgcggcgcgtttggatgctggctgcgactgtacccgtcttccaatttctggcggccgccacggacgaaacgcaatacttcatcgattacggcttcgatcgacgatgaccctacctccagttcttctccctgatatgaatattgtatattgttttctggttcctaatcctacggcacttcaattttgcatgttaattttcttctcatgccatggagaagcggccggcgacagcacctgaccctcgactctaaacggttcaagctctagcctttagaagccgatctccaaaaaacacaagcacgaagagcacatcagaagcgatgtcggtggtggagctcggcacatcggccatggtgctcccatagtcccatatatgtcagtctcagggacgtctgcggcgccggaggaggaaaaggacgacccctgcagtgccggaggaagacgcgggtcgctgctcaccaggcaaaaggagatgcgatatgatgttcgtcgaattgagccgacggagagcttgaaagacacggctgctcgtggagccaagccgcgtgtgtcctcatcacgcaacgccgggagccggaccgagctaaccgttcgatccctatgtcatccacgtggcatccatccgaagcggggctgtataagaggccggttacatccggtctccactgaatttttttccgtgatgttgtggtgtggacggtgtggtgggtttggttaaaatggagggggcttttgcggggattttgttgggttgcggcttgtgcgggtagcgggtgcccgcatgctgttctccccgtgcctcgcgaacaaaaccggggccgtggccgtggtggcttgtgcgcggcgtctacctggtgtgacgcacgcacgcatgcatggccagccaaaccacctactgcggcatgtgcccatgcatcactgttcggtgaatgagtgaatacatatgaatcgcgatcgccaccgttgggggggcacgtacgtactatacgtaactatactattgtagtgcatgcctttttgtgtagtggaccaggatgtggtaggggcctggtctggtagttgatcgagcttatggtgagtcgtcaattttgaaatgtgagattggtcaacagtatgtatgtatgtaggtatgtcttgattaacagtttaaacttttgggcgagctggttgcaagcggttgttcttacctgcatgcatgtctgcgaagctgtagccaattttgaatttcatttgaattaatttagatgttcctcttatcgctttctatttctatcgttaatgatatagttctcgtccttgtacatcactactccgaataaacatataactagaataaataaaaatatttttggacagcatcaaggatataaatatgaatcttagttcaaaaatatttctatttattctggttatatcaaaccatcaaggatataaatatgattatatgaatattagttcaaaaatatttttatttattctagctatatgtttattaggcatacagggtagtgatgtataaggacggatctaacatagaaaattgggacagacgatgctgacgactttttttaaaacctatagctagtcttgtttataaatgaatataatatcatagtttaaccatgaccggcatgttataacaccgatatatacattatatattgatctatcaaatttctagatccgtctctggtgatatatgttgggaagtaacatctaggcaaatgcaatggtaaaaagtcattgccttatgggtaggctgatttcaaaaaccttatcagttatcacaaattcacaatgtgcactcacgggtttatttctcccaaaatgaaagactttttcaatgaatatgcacccccaccattcacaaaatttgaagttgaaattccagcgatgagaatttagaaaaaaaaaatgaagttgcaccatgcccaccattcttctgctataccccatgagacctcaatagcatgcagttcttctaccgattccctccaaaatcctggcatttctctctttccaagcctttctagtaattaagattacggactcgtgcgtcaaaaatttccgttgaaacttttgcatggaaacccaagaagagtatcaccaagtttccataacaattgacagatctggtttcaggtttaaccgtctgcggaccattttttttctaaacttttcgtaatcatttgaccaacaagtggggaggtactacacgcacgatcgagaaaacacacccaacataggaattcaaacgactcgcaagaacaatgttcatagtacgataatagtacagatgccaaatatgagatttcggaagggtcaaatccaaatagtgccctttgcctggcccgtccggtcccaccctgccagtagcacatacccacacacatgcttcaacgtcaaataatctctctccgtctcc

SEQ ID NO: 69602 - DNA, 24175 bp, Oryza sativa
acctaacctcacctgatcgatcaaccaaactaaccgcaccaagccagcaaccactcgagcactcgcggctaaacctataacaaaccggcgcccccgtagcgtagctatacggcgtacaccacgcgcgcggagttgcagacatgagagcctactcggcgacggcggccgcggcggcggtggcgtcgctgccgtcggccgcgccgccgctgactcccgacgcggcggcggtgctgtcacgcgccgcggcggacgcgtcgaggcggcggcacgcgcacaccacgccgctgcacgcggcggccgcgctgctgtccggcccggcgccgctgctccgcgacgcctgcgtggcgggcctcgcgtcgccgcacccgctccggtgccgcgcgctcgacctctgcttcgccgtcgcgctcgaccgcctcccgacgtccacggagcaccagcaccaccacgcggcgccgccgctctccaacgcgctcgccgccgcgctcaagcgggcgtacgcgcaccaccgccgcatcggcagcggcgtggtcgaggcggacgaccaccgcgtcggcgtgccgcacctcgtgctcgccatcctcgacgacccctccgtcgcccgcgtcatgcgcgaggcatccttctccagcaccgccgtcaaggccgccatgctgcgctccctctccgaccccgccgcccccgactccggcgtctacgtcaacgccagagtgctgcaccggcaggtgtcccaccgggaggaggaggtgaacaaggtggtggaagttctcaagcggggcaagaagcgcaacccggtgctcgtcggcgacacggtggacgtggacgccgtggtacaagaggttgtcaccatgatacagaggcaacggctcggcaatgcgcgagtcatctccttccagagagaattcggcgacctggtcgatctcgacagggcggagctcgccgccaagatcaaggagctcggcgaggcgataagatcggagctactctcgccggcgtccaggagcgccggcgtcgtcgtcaacctcggcaacctgcagtggctcgtcgaggagagatgcgtggcccccggcgagcaagagaagcggagggacgtggtgctcgacacggcgcgcgccgccgtggccgagatggcgcgcatcctgaggcagtccggcgagcgcgagcaccgcgtctgggtgatcggcacggcgacgtgcgccacgtatctcaagtgccaggtgtaccacccgtcgctggagagcgagtgggacctccaggccgtgcccatcacgccgcgaccgccgccgccgccgccgtcatcgctcggcctctcgccgaggtttgcatccgtgacaaacacagcatactgcctccatcatcaacctcgcctttttttccacgacgataacgatgtgtttgtgttctctttgtgttttacagtgttaatggagttaacagaggcatcctgagcagctcggtggaggtgttgtcatcggcgatgaccaccagtgcaatgcaaagcaggtcgccgagcctgtgcagcgcctgcctcgacggctacgagcgcgagcgcgccgacatggcgtcgtcgccgggctgcggcgcgctccatgccacggagcagcccatgtcgcagtggctgcagatcgggacgccgagcagcgcacggccaccgttcgaccgcgcgcaggttggttcggtttggtttttttgccgcgcacgacaacgacaaactaagccgcgtcgtgttccgtcgccgtgagcagcgcattgacgtgcggaatctctctctctgtgtctgtcgctttgcaggacaaggcgcgggaggctgacgagctgcgacgtcggtggctcgaccggtgcgcgcagctgcactcccacggcggcggcggctgcggcggtggccggccgtcgtcgatggtcacttgctcggaatggaacggcgcaagcgtcctcgccaacatgcaggctataccagtaaggccgccgccaccggcggccgcggcggcgcctgccgccgcggtggacaccgacctcgcgcttgggccggcggcatcaacggcgtcgaggccaccggcgtactgtgacaccgacgagaagctgctcgtgaaacggctcacggaggcggtgcgatggcaacccgaggctgctgccgctgttgccgctgcgatcacgaaggccaggtccggcgagcggaagcggcgtggcatggggcccaccagggccgacacgtgggtcctcttctccggccatgacgtggccgggaagacgaagatggcggaggcgctgtccatgtcggtctttggcacgaacgccgtcgcgctgcgcctcgccggcaacggcggcgagcccatcgcgtcgtgccgcggccggacggcgctggactgtgtggccgacgccatacgtgccaacccgctgcgtgtcatcgtgctcgacggattcgaccaccacgacgacgacagagtcgtgcaggcgtccatactacgcgccgtcgagtccggccgcctcgtggactcgcgcggccgggacgtcgccctcggcgaagccatcttcgtcgtcatgtcgctggacgacacgaggcggtgccaagaggatcatcagttcaccgactcgccatggaaccttgagctccgagtccggaacaacgcacggaagcggaggccggagccgcagccgctcgacggcgccggcgaccggcggttgaaaccgcgcaaagactcgcctccgcttcaccttgacctgaacctgtccatgtgcgaggatcacaccgacgacgacgacagcggcggcgaggaatcccggaactcgtccagtgacctaacggtggagcacgagcaggagtacggccaacccgccgctgccgccgccaagttctcggctccgtcgagcttctccgagctcaccaaagccgtggatgcaacggtggtgttcaagcccgtcgacttcgggccgctcaaacggagcgtctccgacgtggtctcggcgaagctcggggacgccgccggcgccggcgccggtttgtccgtacacgtcgacgacggcgtgctggacaggctggccggcgcggcgtggacggcgggagagtcagccacgtcgttggaggcgtgggccgacgaggtgctgtgccctaccatacggcagctgaaacgtagcttgagcgccaacgatgtcgacggcgcgacgacggtgagcttgtcggcggtggaaggcagcggcggccgccggaggaaggacggcgaggtgttcccgacgtcggtgaccgtcgccgtcgacggaaactgatgacgcagtccacctggcatgcatgcacgtgtttactctttttttttgggttaaattggtcatcaatatgatcatcatcattttgtacattagtacatgtaaatgttcagctgtcagaagttagagatgtacggggctaggaaggagtagttgttttgataatcacattttggattcatttcaacaagacaagcatgcatgggtcccttaatatttgccggtccttattatcattgacctaccaactatgcatgcatggaccaaagagtgtcatcttgtagctagcagtcgttcgtgacgtttagtcagcaacctaatgaattggaacaaagacgtttcggcgtgcatttttggtgatttcttaactagttaaatgatggaggatacatcaatatatatatatatatatatatgcaatatttcaaggttaaggatttgataagtactgttatattggggtaatggcatgtatatgtagggggcatgtagtaacgaccctaacgtattacacgtcactctaggtttggttattcacagcgttttgccatcttttgcaattttttcttgcacaaaccaccttaaccacctgcaaactgacacgacatttcatgttaaaaacctatccagatactgcatatcagtagagcccaagtcccatgcatgcaatgtacagtcatatactggctagtatttgatgattgcctgtacgaatgcaggcaatgctaacagagctcttacacataaggttcacaacccatacagtcccatgtacgaactagcctgtttatacacactcctactacctgccatggactcactgaatacatgccaaatgcaagtcctgtacacctctgcacacatacacagtgacacagacacacacacacagatcgatcgagcccaatgctttctgcaggacatttctgaatcctagctaaaacgagtgcaagcaagaagcaactgtatgccatgcatgccagtagtacattacatacaacctatcagcagctggtaaaaaaaaaaattcagtagccgcccgaggtagaaagagagaggagctaggtagatcatcaaaggtggtcaaaaaagggcatgtcccgcgtatgcgatgccgtctcggatgccggcaaggacgacgacgacgaagacgtcgtccgaaaagaagctaagctaggcagtgtatgctatgttgtacgtatgcagcagcagcaagcagagctagcgcacgccggccggtagctgccgccgctttagccaaaaagacgcgagttgatccaaaaaaatgaggaaaagtaactgcggcgagaccatgccgtaactaatcaccttttaaccccgcccgggttaatctattgttcggtagtacatctgccataatcagcttggagaggactactaggatttttacagtttcacacccatcttcctctcttgtcgtcagtgaacccggtcgtacggctggaatatttggctttgtgcgtatataggagtacgtcttttcatggaagatactgctgtatcacgctcgattcttcagtttcttgattgatcagagcaacccagcagaaattctaccccagatttaattttcatgatgattagtacatacctccatgattgactaatcttcataagggcatttctatcttaattaggaaagagaatgcagcgataatcatattattgctggggagttgtatttggttaagtgcttcagggtaattaaaactcctgtttagttaattaatttaatcatgtacccactgaccaatgttatcctctaggaatgcatgcacacacaagaataagtatgtcgttacaatatgatatcttgcagtacatttcgttctcgtgaggtgaaatggaagggaatagatggaatgatgatttgtcgccgtgccaaaattcccctctggtaaagagagcagttggtaattaattagctaacagtagttagtgatcactagtagacgcctgagacaaaatggttgcatgtttagggataagggccagaggacaaatgcactgaaagctaaagtttcgttataactactctctgctacggcctctgaagtctgaaagtgcatgtattaattaagaaaagctctcagctcagctggcccatttgccatcttctgcgtatcgtctactgtacatctattaaccagtaaataatatgtgaaatcatgctcgcataatcaaaaaccaactctataaagtgtctactgaatgctgataaagtactagtataattaagctggagggtgttgtggtaaccagtttcagagcataattcccaataaactaagacacaaatggtaaattgtgatcatttgttaggacatatcactacaacaaatatggtcttttaggacgaaaagttattgtgaagcaatgcaaagttattgccaacaaatctctgaatcaagatagtgacgtgctggtaaacttgtatctttctgaaagtctcaaagaatcagtcaccataagcttatcccttggtagtaggtgcaatgagctctgagtgggaggagaatagatggacagacaagcattgcagcaggagcagcagcaaagtggatcgatagctagatgccagggacaaaattgctgcatgtttagggataagggccagaggacaaaatagcggcacgttaagcaggtaactaccttagctagagcttagcttttctttgcctttgccattgccaatgcaacccagcatctcactgcagcagtgtgggggggctcactgggagtgggagataaagtggtaaattatacccctccctgctttggtggtttggccacagcttatgaactatagcagctgagttagcagaacagatagaggagaaagaatcaaagacgaagctgcaacactgcattgcactgcactgcactactgcagccatcctccacgcactccgtttcaatttctgcgccatcaaagtccgagccggtgctgctgcactggcatgggcaacggcagctttgcttcttaattttccactgcttgcccccacaggattcagtgccatgccattgccaatttaccatgcattgcctggccccaaaatgttgtggttggtaggatcgagtcgcaacgattagcagcagacttacttccttctaaaaatgaataaaacaacttctctctgtaaatcttgatgtactatctctatttcaaaatataaacttttgaacgaataagacatacgcattacttatatatgtcccatctctcaaagacaaagttaaggtttttgacaggtacttatcaaaatttttagtgtgtatattcatacctacgtagagatatcaaaattcccaataaaagatgtgatacctcccgatatgtttttaagaactgtaaaatcattttatctagtgaaattaacatttttttgtgatagagggagtactgcatgcctacagcgacgacagtggcaaaagcagcagcagatgcaacatgtattgtacagctacaactccagaatacgtagtgcccagtgcttactgtttggtgttcagtgagctggggccagcggcttcttcaggagtcgctctcacacagatagatgcaaacaggcagtgcgagaattaacgctgcgtgggtcagattggatgtcgaggaatagtaatgtgaaattgattgaggcccttctactctctttttttctttaaagttggtgacagtgtatgattgttactatttatgtcggctaatattgttttcaaaattatctggttgtggtcagtggatgatggttacatatgcaatgcgacgttctagatagtatttcaaattttactagcaaaaatactggtcaaaattaacttctaccatgataataaatttatgaaaatatccattttactccctcaaactattttatcaaagcatttaacccattaaactacttttcgacttttttttacactcctaaactattgaaatcgattcactttactccttaacggtatttgtttcttttccctgcataagttgtattttgtatagaaacttaattggatgatgatagatgtattacaacttgcgtccagtcatttagaagcaaatcgaacagataaaggggaatcactataagtgtggtggttaagtcatgagtcgatccatcaaattcaaactatagtggtcacgaatattacgaacacatagatgtgcgttcaataggattttagtgagtctaaggatttacagatggtctctttgagtgtgtgttagtgatacattagcggatatgtaagtaaggtgtgagtgtatagaggtgtttatgcgtgtgtttcttctgtgtaatcgtaaaaatgaaaaagaaaaaaagctgatggtttttttcactcctggcatactgtggctttggggccgataagtgggctaaatagatgggccgagcaaaacggcccaagaaacgaagaggaggatgaaatcataggtccagggtaaaaccttacccaaatccacactgatctcgtcatggcagctccaaatccttctgctactatggcggcggcggcggcgtccacgccggcgagggcttggtggcgggcggctgctccggcgagtgcctcaactgcagctgtaagctgcttccgagttggggccaagagcctgtaagacctcctctctctaagcttcttagctttcaagcttaattagtggggtactggggtttcttgtcgaaacattgggttctggtagttttttagcgtcgggatacacgccactttagggcaaaggaggtatcttgtgttcatgaatcttgctatcggctcggaaattgcatgctttgggggtgaagtgctttgattgacgctaaggaagcaggttccccatccgctcagttcatcatctcgtggaactgaactgtactagacaagaacagttcaagtaaaattcaaagttcagtgtataaattgctagcatttttgcactgaattatgaaaattctatgctgttttggtgttctgaagtgaatttggtggcacgggtgtcacacttaggaagaggctgaattcgagtccgaactgaagtgaaaatgctgattccaagatgctatatttcgtatcatgtgacactaaatcgtttcaacttactatagctagccagctaggtccagttttgctaagttctcaatgcactggttgaatctagtatttactctatactcatgcttaaacaaaaatgtttcaataacgttttacttttcatgtgatttacaactagattgctcaactagtcaagttactttcattaggttcaagtactatatatcagtcttttcttctttttttcgaaaaggctaacgaaggaggttgacgctatattataagcaggagaaaaaaccgaaaatcagcaacagagttgactgtacatgccaggttgccgaagcacatgtgaacaccaaaaacaaaacaattagggcaatattctcgctacgtgtttagcgccacccattgaccaacttcgtagctcatccattatgcagttgatcagctgttagatatcattcttctctacgcttgttcagttagtcctcactctagtagtgagtagtcagtactagtgtaccttattctagtagctagacagtgacatcaacttaacaaaatgtttactttcaatgttttgcctggtcttaccaaaatgcttatgtactttcaacaaattgccttggtcagtgtgctttagtatgttgtaataatttatattctcatttcaacagcacagggcttcagatgacaagcacccgcgcgaacaaagttcggacagttcatgtcaaaagcggggaggcagaaggaagtccaagcacagagagcatcacccgcgacgaggaaactctgcagcgtgacttgcaaacagcgattcaggaagaaaactatgcccaggccgcgaagctcagggacgagctccgagtcctccaggaggacagcaggtcagcagtgctggcagcgaatgcgcggttctacaatgccttcaagaacggggatcttgtcgcaatgcactcggcatgggcgaagggcgaccatgtgtacgttgttcatccttcggcaggccggatatcgggctacgacatggtgatgcagagctgggagatggtgtgcgacgcggactacgagttccctctccagattgatctgcaggatgttgaggtccatgtgagaggtgatcttgggtatgtgacctgcctggagctggttaagaccaaagggagcagcagctggggaaggcaggttgcgaccaatgtgtttgagaaggttgatggcaaatggttcatttgtatccaccatgcctctcacttcgatgagtgaggctgaatttcttggagagaggaagagctgcaagtgcagatatggcgtgaggttttgcagtacaggcgtgagacatatacttcgctgttttcttaaggtccttgatatgacctttttgtagaaccctttttgtaccaatactatcatcgaatgatgctgctattttgaggagtattagtagtaggtacagacaaccagaaccctgatggaattgtaactcggcgtggctgagatattcgtcagactgttaagtcccttttcctactgttgtacgctgcaatctatccgcgtgcagatgtattttgccaacagatttttgccggttgttacagcatccaacctgttcattgctttagctaacgtcgatttgatgatgaaactccccaaggctcgtgatcaggggcatcaaaaagaatcatgcacattgcaggaagctgcagttgtaggggttgcacaggttgagcgacaatcaaacagattttaagaaaaactccaatgaacaagatgaaatatggaaccctcgcacatccatacaaacacacttgcaaatatcagctgatataggaaatagctgcgagttcagttattctcgtccaagcaaaaatagtacagcttaagttcaggacacaggatatgcgcaaaccaaaagtactatttcaagagacatactgatcgaacattcatgaaaagtatgtaacgcttgcagggagtaacaaaattaatttggccttggtgttgcccactcaacacgaaggataaggttatcataaccataaccattgagcttgctgatagccttctcagcgtcctctctgtgaacaaagttgacgaagccgaaccccctgcttgctccagtcttctgatccaccgcaacgtagacacggctaactggaccaaatgtgcggaatagctcaagtaggtcgggttcacgggtgtcctctgatagattggtcacacggacagagttctcatcattcctacgcctcatgtcatgtccaaccctatcaacagcaccagacctcatgcttggaggaacatatgctcccttcacggcgccacctggaggtccagagccatcagcagtgggaggcctgtccacaaaagcttctgtctggggagctagatccttgtaggggcactttgaggtccagtgatcacccttcttcccacaggttctgcaaaccatgagaactgcaccactcttgcttgccagtggatcaccagaagcacttggttcttcagctttgctccctaaaattaaatgaacagttagcaaagaagaagacaggcatacacatttacaagactaaagcaaagttagctgagcctttggggaaaaaagggagaggttcttcagctttactctataaaattaagtgacagttagcaaacaagaagacaaaggcataaacatttacaagactaaagcaaagtcagctagtatagatcatttggaacaaaaaaaatgaaggatctcaacaaggctgcactccactaagaagatttgtgtcgatgcattagaagaccaaaagcattggttataacaagcataactaaatgtgacgatactatgtacttcgaagatcaatttggtataaggacgactggacgagggcatgcacccatgatagatatcgaattacctatgcataattcttgaacaacaaaactaaagatacaatgccactgcaatatgaaaattctatcatcagacaatacgcatgactaacacaccaaaccacaatcaattacacaatacgcacataataggtattcacaaaagaattgttttcctgatccaccactatccagtattttcaacacttctcttaggaagaataaagacgtgttaatctgcattatcgatgtcccctgtctcaatattcgattaaaaacaaccgcagcttctctaaagatctaactgaaactttacactcaagtccaaaaatattaactttggactcttattaattttccactcaatgttaaaaatattcaaccccagaatcgcttcaaaattaaacaaaacttcaaatgacattcttgtgtcaccataattacccatttaaatactcctttcaatacatgcagattaactgctcctataaagctcaatgattaacattattgcacatttctttctacctagatgtgtgcctgcaaatgataaaactgaaaccaagcaagcaagaaaaattataacagagtcctgacgtatgtagtgttcaaggaaagcagcaccagctgtttcctaaatagatcaccagcctcgattctataatctatctcacatagaggaatagacagcacgaaacattccaatacatcgtgtctagttctgatgaagatcgcgcacaacgataaacaaataattcgattcgagaacacgtcaatcgacgcagatctggacaggaagggggatgcacaagaacagtgacaacctggggcgcgtgggcgctcaaggacgatctcctcggtggacaccatggtgagccgcgcgccgacgtcctcctgcacggcgtcgccgaacttgggccacgagcggcgctcgatggcgctcttggagaggcgggcgcgggcgatcttgcggacgcggaaggtcctggtgaccttcaccttgttccccttgtcgtcgaagcgatactcgaccaccttcttgaacccattctcgtcgggcccggagaccacgcgcggcgggagcaggaagtcgaggtccccctcgtcgtcctcctcgagctctccccacctgatcttctgcgtcgccacctccacggccatggcgctctctcctctctccgctgcgttcgctagggtttgcgggggcggcggcgtgggagggagagagtggggaagaagacctcggcgtaggaatggaaatggaacgagcggctcggatcgttttgtgcgccccgatctgtaaggcggtatccacgttgatgggctttttagtctacgggccggataagttaggcctcagagacattctattgggcctagtaatattagtgttctcactaatttggatttgtacacacataaccaaccaccaacattcaaccatgcaacttcctcaaaatattataactgatgaaaccattgattcaacaaaatatcacactaatccaacactatagtatgaaacatgcaaagcagatagtagtaagtataatactatgttatccctccgtttcatattataagtcgctttgaccatttctctagttaaaacttcctaagtttaacccagtttatagaaaaaaattagcaacatctatgacaccaaattagtttcactaaaactaacatttagcatttacaactcaagttatattttttctataaatttaaatcaaacttaattttttatctagaaaaaatcaaagcaacttataatatgattgaaacggatggaatagaaaattttagtgctagtaaaggctagttgggccttggagcagcccactcgacattaaggatgaggctatcgtagccatagccattgagcttagcgatggccctctcggcgtcctccctgtagacgaagctgaggaagccgaaccccctgctctccccggtccggtgatccaacgcgacgtacgcgcgggtgagcgggccgaagctgccgaacagctcgcggaggtcttcctcgcgggtgtcctccgacaggttggtgacgcggaccgagttctcgtcgttcctccgccgcatttccgactccctcggcttcgggggcacgtacttgcccggccgggatccgccgccattgtcgccgccagagttgggaggaatattgttgtcgacgagagcgtcgagctgcagaggggcgaagtccttgttggggcacttggatgtccagtgcttgcccttggcgttgcagatcctgcaaaccatcagcgcggcgcccttgtccagtgcggggatgagtggatcttccgatttgctccctgcagtgtagaacagttagcgaataaagatttgcatgcagaattgggtgtatgtttagaatttatattcctcggatagatattctatacatgaatagtttaaatatcacactgtatttttagaacggatcggaattgctacaaaacttagtatcccttttatgtcgaaaagaaaaggaattagtatatcctttgttcagtctcagatatactacatggcctagtctaaatagatctgtaacacgtatctatacacggctaacatgaaaaagacaaattcaaaaaaaaaaacgatcaatccattgttgcagattgatctagcaaagttgcaattaacgagcaacgtatatacgtagtactagtgaagaagagactactgctatacctggtgcgcttggacgctcgagaacgatctcctcgggggagaccacggtgaggcgcgcgccggcgtcgtcgttgtgcgcggcgtcgccgaacttggcccagccgcggcgctcggcggcgcgcttggtgacgcgcgtgcgcgcgacctcgcggacgcgggtggtggtggtcacccgcaccgctttcccctcctcgttgagccggtactcgacggttttcttgatcccgttctcgtccggcccgatgaccacgcggggcgggagctgcagggcgctgaggccgccgccgccgccgccgccgtagtcgtcgtcctcgtcgaggtcgctccaccgcatcgtctggtgcttagccgtcgtcgccgccatgattccgttccggggagctcttctgcgatggttgtgcgacgtaacacgatgcaccgggagttatcacgtagggtttgttaggaggaatcgtggtctaggattctggtgcttttataaaggaaggggagagatcggatgtgacacggtgttgcggcccggcccaatagggattctggtcggtttcgctagaaatcaggcgtgaccgcgtgagaaaagggaaggaaaaggcataagatcatccgaggtcccttaacttaccgaatccgattttcatccttcaaccgaaaaaccagatacaacaggtccatcaactgtcaaaaccggtgcaatatatgtccatggcggtggtttagatggtggttttcgctgacgtggcacctacgtgactatttagactcagtcttggtaataacgtggcgcttacttggcaatttgatttagaaaatattaaaaattaggaacccacatgtcagttaaaaaaatagatttaaaatgatgggacccacgtgtcattctcaccttcctcttcttcctcctctctcccccaactccctgtattcactctctctcccctctcctctgtcctctccgccgggtgacgccgggcgaggaggggcggcgccgttctgctgcgcatcgcgggcggagcggccgacggagtgttgctgccgcgctcgccggcgacctcgtcctctgcctccctttctcctccctctgggcaagggtgttctgaacgtgtacgacctgagcaacagcctcgcgcggcagctctccacctccttcctccgcaagccaatcgaggccatctggtgagtaaatcctgttccagatctgtttgtttattctggtctaaacgatttggatttttggatttgggtttggctcaatctgatttgttgtgtaggcatacgggcgtgctggtgtacgggaacaagtacttgtacggcggcgggatccagtcgctgccggtggggaggacaccgtacgggcggccggtgcgggtggtggagccgggcgtgacgcacatcccacgttaggtgttcgaggacttcctccgtgagaacttcagcaacgagtggcgcaactcctcgtcggcgccggcaccaccgactacaccctcaacctccccggcgaggtgatgtccagacccatggcgggcggagcggccgacggagtggagctgccgcgctcgccggcgacctcctcccccggccacctccgccgcccgtggcctgctgccgccggcgctccgcctgcccctccgctcaccccgcggtctgccgccgccccgccgctccacccgtccctccgctccgccaccactccgccggctgtgaggcgagcgccgtggcgcgagaagcgcccgaagacggcgcgatgaggaagaagagggagagcgtggagcaccgccttgcccctcgcctgatccggccgccgccgctccgccggcctgctccggccgcggctcgccccacccgtcgcttgctccggccgggagagagagaggatttattttgtgtgtagctgacatatgggtcccacgatttttattattttttgagatataaaattgccacctaagcgtcacgtcaatgtcacatgagatgaagaccaagtcaaagaagccatgtaggcgtcacgtcggccaaaaccggactgaccgagggatcttgtttgcccggttttcgtaagttgagggacgggtcatacccggttttgcagttaagagacgaaagtcggactgaccgacaaattgaaggacctaaagtgaacttattccgaaggaaaaacggtcaaagcgcgtgcggctgttgggccgcgcgggcagctaggcgtgcctgggctggtctctgaccgtctgacgcctgttggcggagttcgcgttctgcgcggtccagccgaaaccagcatgccgtactagtcttttataggaaaaagtacatcaaacgtccctcaagttgtcatcgggttacaaaatcgtctcctaaccacacaaaactgttcactttaaatcattcggtggttttggccctggttttatctggcgcgtgggacccacgtgggtcccacatgttcgactgtccacgtcatctctctctcccccctcttctctcccttccgcaagcaccatccacggcggggcttgtgctcctctctctagtgtcccatgggtgattcgaaacggcggtggaggagaagccggaggtgaggcgggtaggcgtccaccggccggaggcgatgaggccggtagcgagtgcacaagaagagggaggaggcggcgcgggagaaggccggggcaccgtgcccgccgagtctacctccgcgcccaccgagtccaccgacgtcgtgtggccccttctcccatgtcgccacgtcgcatgtcgcctgcctcaccccggcgcccagctgggcgacgttgagctccttcacggtgaggaggggaggcattgtgctccctcctttgcgcccctggccggagtagccgccacagtgccacccgtcactggttattggacctcctcctttcccgccttgcctggccggcctcctctgcacccgttggccaccctgcctagagtcccagacgaggagaagagtgataaagaggaggaagagaagagggaaaagagagagacgacgtggacagtctgacatggggggcccacgtgagttccacgctgactcaaccgccacattggacaaaaccagggtcaaaaccaccgaagaatctaaagtgaacggttttataagttgagggatgccatatatctggttttatggttgagggatgattttgtaactcaatgacaagttaagggacctttggtgtactttttcctctttcctatggtcacacggaccgatttatgtaggcctatgcccatttgttagcagaaaaagttcaatgtgcatccctcaaatatgctttgaattttatttgtatccttcaaccgtaaagccaggtatagagattcccttaactactaaaaccaaatcattttatatccctaagtggttttaatggtgattttgttctatgcggcactagtacttttgacttggttttttatgtgacgtgacacccacgtgatgctaacgtgttaaaacaaaactttcatcttgcactggtctgctttaagggcctattcgactgattgttctgctgctggcctgctgcggcgcagccggcaccaatagtgtcgcacgcacacgacgcagccgcagccagcttgtcgaacatgccataagttgctagacatatactaaagaaaaaaaaataaaacttttcacgtgcctatttgtccgaatcaacttacgagaagaaccagaacaagtcaccgggaataaggaggggagctcagcggcaccatcatctttcacaccgcgctcacccccactcctaccagaaccatgcctacccaccgacaacaccatgaactgtgttgccaatgtcgcagatgcatggtcgatggctggtgcgcgaacaatatctggttttacggttaaaaaaaaaagtaaagtggacctttacctccagaggctaaccctgctccagcccagttattgggttgcttcaccaggatgcatggccttctatagtaagctgtttgatcagccttccggctatggtcggagataggcatgtaaaatgatggaatgtagtggtgcctaattaattatgaatcaactgaaaaaactttaaaaaatatattagtatgattatttaaaacaactttcttctagaaaattttacaaaatacatatttttttagtgatttaagaaacatgcacgtaaaaaacgagtgaggagaagtcgagaacatagagaaaagaacacatccaaaataagtatatgatacagtacacccaaaatgagtacataacgcatgctgatgagtcacgggctcacggccaagatataaagaagcaccgctacgtaatattccagaacatttgattttttttttagagagagaatccagaactttgaattgtagcaagtcgtcgtagcacaattttactaccgagtactcgtatttccagaacatttgaattgtagtgaaatcaccggaccattttagcacgcaccacgcagccgcctaaccattttcacggaggtagtagtacgcgtagtaatagtacggaggacctcctcttcggtcttcagaagtcaccctttctagaagaagaagacgatggtaacctgacttctcctgtgatgcgcagcgctgggtcccacacttgggttcctccgcccgccgccatgtccaacgtccgaccggggggcggggagcgcggtcctcccatcccgtcatcaattcaaaaacttgaatgccccttccgatgatgtcgcgctgtgtgtcagccgcctgcagccggcaactaccccacccaccccacgccaccgcggctcgcacgtgccgctgccgtctccccaatccccatcctgtcgtcatctgccgcctcgcgggccagccaatgcaccggctgtgccatggcaggtgggccttggcggaggcgggggctcacatggaaattagtaggagtaccaacgtggtgggggaggtggttagccggcagaggcgtcattgctgctgcgtacgcgcgcggcggcgtgctaccaaccgtgtgcttgacgccactggcagcagagcagaagccggaataaaggcagtgctcccagtgggtttgggttccgccttgcgtgggtggctggattggatgccccactagaccactacacacattctccgatcccaccctttccacatgacgagagctaccgggaaatttgcaaaggaacgggaaggaatcgacgaatcgttaggtgcacttttggtccttcaccaatcactctggcaacataaacaattgcctgaaacaaaacagatccgacattgctccaagctaaccttgctgtttatgactactgtttagtgagtaatagagcttgttaagccaaagtcaagcaaaataaaatagttcgacatattgcacttttcaaataggtaggatcataggaaaaagaaaagaaggcgtaaaaacatggttgttgattttatactaattttcactgttatagtttttctcactataacaggacgtgaaactgataacttaagggggagttgcattttttttcttctcgttattataaattattagatcgtattttctcaacctaaatcacaacttgtgtctatcaacttatttctttgcgtgcatgaaatataagtatagagttttatagatttatgtgtatgtgttatccgttgttaggtttgcgcaggctcaaagaaattgttagatctgccactgatatcactaccaaatactcccatagtatctttaaaattcagtgtcaaattagttatctactcttcctatatatttgaattcagttactcaacatatatacgttgagccacatcatctataaaataaggatagctggatcactactcttaatcacatcggtcggaacacttctatgcataattgcatagaacggattgactatgtaggtataactgtaggtattgatagagcaagtgatccaatacaacctgactatggagaatatggggtactgggtacccacacgacttctatatttgactagagataggaggtgagccaaatccatgtactatgtaatagagtaggacttgatcacaatgttgtcttatgttctataacataatttagaatcccgaccggtattaagtaattgattaggaaactgatactgtgtccggctaggtattactctttgtaacactacccctaacctatataaggtgagcgggaagctctccaaagacataaccagagatagcaagataagtcacaattagattatcatatcaatatatacacccgacagatacaattccgaaataatagtaaggtattacctcttatcgagagagccctgaatttgtcttaattcttgtctctgcatccatcaatcaacttttagatctcatgtgctattctttttaattattgcccatttccataatcgacactgacattgctatcatgctcatcgcaagctcaaacaatgagatgttttcttaataagtacgcgcgtgattgtgattgttaactttcaagatagacatggtttgacaataacatttctttaccaatgacctgattaattagccatttattgtatggttgttggtagttaaggctataaggaatcaacctttgggcgcaaaagagtataaagtatagttttaatattgtggcaccacaccttccacatattttccttcctttaacttgttctataccaatgataatgacggtaaaaagtttcacctcttcgagaagttattgattttatcaaacaaatagaaaatgtatctattaatctataattaaatctctctacttccactgtaaaaaactcaaacttttgaaacaacctgctgtgcaaagctttatattaatacagaaagggaaaaggtaacactgcaaccctgaaaaactataacaagaaaagaacaaaacaaacacacaacccaagagaaggctctagtatcaaatcgaccgctattgagcatgaccgatcgccgctagaactataggggtcgcacacacccttccaaactcaaattccacataggaggtcgttgacggtctcccgattatcatcacgtataaggattggggagaggttgaggacgagagagaccgctattgagcatgaccgatcgccgctagaactatagggggtcgcacatacctctccaaacgcaaattctacacaggaggtcgttgacggtctcccaatcatatcacgtataagcattggggagagggagaggacgagagagaagaagatccactcgtccctcgagccaacctgacgacaacaaccaaaataaggccaaggaccaagctggaggaagggcggcaatgagcgatgaatacttcataggcaacgtcttcaaggaggtcatgacaccaaatggcaccactgtcgcatgtctagatgaatcgggttttcacccagagagtcttaccatgaagagggggttggtagctccacaacactttaaaggggatttcacaacattcagagatgtcatatttgctggctaaaaaaaaagaaatcaatttttaatttttgtatgtatgaatctatatataaaacaacttggtttattttaggatcgaggagatactatactttgaagatggctctttcgagttcatactatttcgaaatattggattttttttctaaaaaagtataacaaaattctgtaaatattgtaaactcttagcactgtattccggaccaaatataagattttccgtaggttgtaaaaacgggcgagacagcgtcaaaatcagcaaacctggacgtgagtcgtgacagagcaaaaaaacaccatcatcattcgtgtcctttccattctctcctgaaatccatccccggccagacgtaacggtcacgcgctattggcaccccaagaagatgcaaagcagcagcacacacagcaataaagcaacgcgcaaatcggtgtagtcaaaactcatctcctctatataaacccactgaaaaaaaaagtcggcacgttttttcccccaatttcatctcgggccaaaaaaaaaaactccagctcgccatagctcgccataggagaggggatttcgaagctgctcttgcttagctgcggctgcgagtgatacggagtagttccggtgatggagcgagcggaggagacgccgagggcgccgtcgacggcgccgtcggcgagggtgtcgatctgggagtcggtgcgcgcgtgcggggtgtgggggaaggaggtggacaaggccgagctgcggaggcaggtcgtcatgccgctgtacgcgcggcgtgcggtcgcggccgccgtgaaggccaaggacgaggccgtcggcgtggcggcggcggcggagaggggcgaggagggggaggtggaggtggaggtggaggcggccgtgacgccggtggtggtgttcgtcaactcgcggagcggcggtaggcacgggcccgagctcaaggtgcggctccacgagctcatcagcgaggagcaggtgatgacatcgccgattggctcggccactcgtgcaaccctgtttccaaattttcacgcttctccccggttgttcctgtgtgggttgttggcttgttgcttgctcttggtatggttttcgcgagttgcgagtcattgattacttttgagattcctttgaaaattcgcagcgatttagacgtatttctgtggaattacactgtcggtgacgtatgaactttcgttctagagtggtactactaccggaaagaggggcaacagcctcagctccgcgtgtgatctgatgaagattttctggctcgaccaatgccatataaggtcaattcaattgctactttatagaaaatggattgctagtagtatcgtactagattttgattttccatctccaaaatgaattttaaatttcctgttgttatcacgtagtactccgtaagtagaatcatgaagttcatcgtgcaattggtactattagcatttatgttgcttattggagtttggacgtgccaacgaaaaagcgtgtgttctgaagagggggtgtagacgtgtggttggggtcttggggataggatgaggagatggagatactaacattgcggttggatgataggtgttgtgaaagcttcagcctccagcagattgtgcatttgtgcctcactttctcgcatggccctggaactttgttgatatggagggatgaagaaaaatattgaagatggtaagcggcaggttggcagggagggaagatcaaaagtttaaacatcagaattttagctccatgcttgcttctgaggtgtaagtggctggagactagttcggcggcctctaatttttggcttgacatgctattccaatagaatacagtcatttgattgtactgttatcttttacggagtttttttttttttgctcaacatggaattactggattttatctgggttcattatgtatcaatgtttggaacctgaggatgtcctatgtaagcattttgcacttacactttgaagattattcgtaactgtttttttaatatgatcaactgatcactttatgtattcacacatgttttcagaattttttccttatccttttgtatgttctgggacacaatattacatactgatgaaactatttccaggtctttgatctctctgtcgtgaagccttctgatttcattaactacgggttgggttgtttggagaaattggccgaacaaggtgacaattgtgcggagaccattcgaaaaaaattgaggattatggtacgtgtgtaatggactttattaggggtactgcatttgttataagtttagagttctctgcacgtttgagtagtcaagcattagcatctgttaaaacttatgaaaggttgttgcttcctttactatcctatctacttataaaataatttatgacagggtgtccttgttctttccttatttactgaatttctcctatgttggctactcattgtcttccaactactttgcataacatccttgcactagttctttctgacaggttgctggtggtgatggcacagttggttgggtacttggctgtctcacagatctttataggttgaaaagagaaccagttccacccacaggtatcatcccacttggtacaggaaatgatcttgccagatcatttggatgggtaaggatccatatatgatgcaattgttctatttatatcctttctttgtaatttacagtgttaactaagcttttgagggaaggtgagcgattcactcatactacaactaataagcatatgaacagggtggctcttttccctttggttg

SEQ ID NO: 69603 - DNA, 1382 bp, Oryza sativa
ccgcctccttttttgtgaatgttctcggatgaacatgttaatacatatggttgtgttaaaggaccaaatctaatattgtgcaggagaatggcactgagttacctgagaaagcttcttgctataaaggagtattctacaactaccttagcattggtaatccttaatcaaccttttttatttgttccttctgtttttttcccatgaactttacatggtgattacatttggtagaagcattaattctcatgaaataaatcctatctctatcctgcctatgctagagatctttaatattcagaccatctggttaataaattggtggttaggtgactaggttctaagtttttgctttagttcccatgtgattagactttcaataaaatgacaaattagtatttcagctggtcgtttgaaattctgagtgacataaataaactaaaacttaagatggtgttcctaattgctgtaatgacataaagttgtaggacatgtagatgtaatgatcgtttaagtttcatcaagaaattaatacttgtttaatgatttttctcttgtgaatcttatggcttcttgcaattatttggaatcttggtcatcgctgagtgctccttattttatattgaacagggatggatgcccaagttgcttatggcttccaccatcttcgtgatgaaaagccatatcttgctcaagggcctgttgcaaataaggtgctgagttgctgacagattttctttatttctgtattgttaattagcttaaaagtccttgcattcagagtgttctagttaaatgtcattatgtcacttgcatattttataagtagcagataagtatgacagctgatagatcacatattcccacacatgcacaaaacttgtgtttatgtaccctcattttacagtaagttccggatgttctattatcctacgaaacctactgtgcatacctgatacatgggttagatgagacaccgcttatataacatatttgaaattggaaaaaagaaataacccagcttcaatgtcttatttgtatgcttttgtgaataatctcagtttctgtaacatagttgttggtatcacagtcatgtttatcttataaatgattcttgtaatgatctttgtttttattctcgtgcagttgatatatgctggttatagctgcacacaggggtggttctgcacaccttgtacagcaagccctcagttaaggtatataaagacagcctgcctttccatggattctaaaatggctccaaagtccgaactttatggtgtcaggcagttttgttttgatccactcaagaatccggaagctgccatgattttaggttaattataggattttttgatcatttgatatattccctccgtttcagg

SEQ ID NO: 69604 - DNA, 1973 bp, Oryza sativa
tttggttaaagtcaaactactctaagtttgactattttgtttagaaaaaagtagtaatatttttaacccaagacaaatatattatgaaaatttatccaattatagattcaatgaaactatgttggtattgtaaatattactacttttttctataaagttagtcaaatttagagtagtttgactttgaccaaagtcaaaacgtcttataacctgaaacggagggagtaccaaacttctaagatatatcatggatctaaacatcgtgatgaatttgttcttagttaacatctgacgacatgaattcaagtttcatgtgtccatcattatccaaaaaaatttcatgtgcccatggcactaatcatgatgcaatagcaatcaactatgtctttagcttttctctccatgttttgatggtttaataaaattacagctatgctatgatattcttcctttgtttgcacacttctctttatctttgtttgaagctgatagaatggtttgttgttgcagggggcttaagaacattttgcgactttacattaaaaaagtcaattgttctgaatgggagcaagttacaatgccttcaaggcaagttgttggtttcttttatatgaaaaaaaaggcttttaaacaattatgatccttaaaagaatcactcaacaattctgtgagatgctgacattttgttaaatctcgactactttaaatacgcagtcgtcttcctccctcccgtgcaacgcgagaatattccgtaaaaacccgaaccagcccaccctgtaaaaaaccaaaccggcccaccccgtattactccagatcctgttgcaataaacgggtatagtactagtgtaagtaataagctagggataatggatgacacttggtaacggacaacgtatgcatatacatgacctgatgccatgctgacccgtgttcacaaatcttcagctgaaaatatgaaaaaaaagtaattaagattaatacaataggttcaaatatgattgtaggattttacatattttcctaaattgtgtgatgccaaaagtttaaagatactactacgttcctatatatgaatgtcttagtggcccttcatccttctgccccaaacattctagtagtgaaaaactctctaaaaataccagaagcatgaaattctgatcctgtattcctgtacatactggctggtgacctggtgtgtcaggcattcagaatgtaatgtgtgctatgatactgttatgaagctcggaagaaatgtcagcatataataaattctggacatacaagttgaattgattatcttcccatttgggagaagtttggaacttaagtagctattgttctcatctttcttttgaatgtgctgtatgaatccggttctgtatttcacagcttgcattcttttcccaactgcagtgttagatccctggtggtcttaaatttatacaactacggcagtggaaggcatccatggggtgatcttaaacctgattaccttgaaaaggttagtagttaatatacatttatcatgttcattgcatatgttctctcaattttagtttgtttatgtagggctttctatgactataaagttgcatcatggatgattgctcagtattctttcaaataattatgtattatttaagaaatcgttctgtcagtttagttgatgcagtagctagaatcagctgcatttaatgggaatgcgcatgcggtatttgcatttatatgcaaattatgtgttcatctttttctttttttggaaacaaaatgatgctttattctattccaaatcccagaaaggttttgtcgaagctcattccgatgatggattgcttgaaatattcggtctgaaagaaggttggcatgcttcattcgttatggctgagctaattaaagcaaagcacattgctcaggtacttacatttgtttggcacactatatttctattgagtattggcaaggcattgctgggc

SEQ ID NO: 69605 - DNA, 11691 bp, Oryza sativa
cttggcctctgaaaccgctgccatgtatcaggctgcagccatcaagtttgaaatgaggggtggccaatggaatcgtgcgtatgttcagatggatggagagccatggaaacaaccactcctacaggagcagtcaaccattatcgagataaacaaagttccttacccttctctgatgataaatggggagcaatgagatcttccccgatttcaatcaggtaatattcctgaaagttcatttttctgctctgtacagcatctcgtttgctgatagctccctactcaccggtcgtcagttttgcatttcataccagggtcgtattctagatcgttagattatgtatagttcgggagcagctgcagggattagccatggccggagcacaatcgggcaaaatgtactgttgtatcatataaattatgttgtgtcgtaggttatttcagtggaaatcaaatataacttgatttgtaatgtatttttaccgtcaaaacaaacaaaaaaaatcaagtggaaaaacacaatgtactgtaaattactcagatttcccctcctgttatgccaatttggaaatcttttgctgctgggcttgaactgaggatatgttcagtttgtcgctattttcaatgccaaaattctggtagggttgtgaattgagtgtcgcccagtgagtggaatgtagtagaacctatttagctggtttaagtactagacttaacatgagtgcatgtatgtactacttcatatcgacaataactcaatattaagatatataagcttagtctctaagatgtgtttagggaaaataagtatgactaacggaaatttatcaatttttttagctggtttaagtactaaacttaacatgagtgcatgtatgccctgcttcttatcgacaataagtcaatattaagatatataagcttagtctctaagatgtgtttagggaaaataagtatgacgaacggaaatttatcaattttttaagtagttaagaggtagtataccgatgaacatgctttcatgtatgtatttgattcccaaaatacatctacattaatcacatattattgttgccatattacactttacaaagccactgccaatgcttcatcggtcaagttgctgaatttctcatctactggtagtagtacagtagtactaggatctatctacaggcgaggagacggttgcacactacttgtacttgacctgtcaatgttcatatcctaccggacacgtctactgggagaacttgccatgtcacatgtacatctaccgcggttgagatgttcccgccaccaccgctgcccgatcggacgagttatcgaactccgccgccgccggagacacggcgccgttcctctcctccgagctcgtggagatgctgaacgggctcatgccgccgacgacttcctccgggatccgtccggcgtcggcgtcggcggcgccggcgacgttgcacgggctctcgtcgccccacctcggcgtccggctcgcggcgtactcgctgccattcctcacggactcgtcgctccacctcctcttgaacgtcggggacttgaggtccttctggtcgtagtgccgcgcccacgcgcgcagccgccgcagcgaccggctcccggagccggagccggagccggaggcggcggcggccgcctccgccgcacggagctcgtcgcgctcgcggtagaagaagacggcgaggtagatgaggagcatggcgctggtgaccacgccggtgatgaggaacagcccaccgaagctccggaagctgaggttcgacgagccgacggcgctgccctggctctggcacgcgccgggctcgccgaaccacttcttctcgatctgcgccatcttctccccctccgccagcgtcaggatcgcccgcgacacgtccgccaccatcggcgaccctctcgggaacacgaacccgaagccgtcggtcttgtagattggtccgaccatggtgtagccgttgcagtactgcgagaggaagagcttgaggtaggggatctcgtcgaagatggcggcgacgccgccgttcgccgagcctttggacagcgcgtcggcgtactggtccaccgtgctgtagctcctcatcctcccctcgaagcccatcttctcgagcaccggcacgatgaaggtcccctcctggaacccgatgtagtcgcctcgcctcaggagctccctcacgtcggtcaccgtcggctgcagcttctggacggtcagcatcgacgtcaggctcgccgtgtagctcgacgtcagtatcagcaccacgaacacccatatgatcaccacgaacctcgacaggttgctctccagcttctcctctaaaaaaacacacaattgaaatcgccactcaaaaatcatgttgctgaattggtagtagaaagtaccccctccatccctaaatatttaacaccgttcacttttttaaacatgttttacttttttaaacatgtttgaccattcgtcttatttaaaaaattaagtaattattaattattttcatatcatttgattcattgttaaatatagtactactactcaagtttttgaataagacaaacgattaaacatgcttaaaaaagttaacggtattaaatatttagagatggagggagtagaaatgagctagagaagaaaaggaggatgcaagcacgtactgtgggagaagacgagggtggagaaggagaagtagaagatgaggccgaactgctgccatggcgtgccgcggaactcctcgttgatgcggtgctcgatcacccagacgacgaagccggtgaagcagaagaaggcgaggctggcgagccagaggctggtggtgagcggctgcaggaagatccacatgctcgtgctcgtctccttctgcaccgccaccaccatcgaccaccccgactccgtgaacggcatcgtgaagtccacctcctccatcctgctcgccgtgatcgtcacatcccccaccaccgcatctgccttctgcaaaccaaacattgcaattcaaccactctgatcgggtaaagtgatttcatacttcgtatatgtcatctaaatagttataatttttttttaaaaaaattggcaatatagattagtattaaatatatcactccacaaacatacagttaaaattcagcttctacaagttgcaacaaaaataacaaatacatatgtgaatgagctacaactattttcaatttaatttgttttttttcaactaacaaaaatcgaatttgatattgcatgtttgtggagtgatatatttcatattcatccatgttatcattttttttaaaaaaaattgctaactatttagataatatgtaaacaacgagtgggtgaaaatccacgtccctctgatcgaacaaatcaaacgaacagattgtctcaagaactcttgaactttggcatgtactgacctgtgacgacacctggtcgacgagcttctcgtaagattccgggctatcggggtaagggtcgtacacgtagctcaccggatagggcataatcttcatgacctcgtcgaacacgtcgatgcagtagccggtgatgtttcgccgcccggtcgccgtgacgttgccgacgtcgacgaactgcgtgaagccccgcttcgtcggcacgctgacacggagcggcagcccgctcggcgacacggtccagcctctcggcgtgtcgcgcggctcgccgggccagaggatttgcctcagcgtcttggcgctgccggcgttcaggtcttgcgtgatcccgaactccggcgtccagaacccgaccgtcctggcgcccttgccgatgatgttcacgacctcgtacgccggcggctggagctgcccgtcgacgagcctgaacttgccggcgagcccgtcgaacgtcgtgctcaggacggcgttgaggagcgccgtgccggtggccgacacgccgagccggtccaggtccgtcagtggcgcgctcgtctgcggtgtctggaacgccgggccggcgacaccggccgactccgccgccgcggcgatcgcccacgccgtgtcgtacgcccagaacctcaggacggtcggctcacggacatcgtcgacggtggggtgatcccggcgtagcctcgccttgaaccgcgccgagaagttcttgacggcgtcggtctcctgcacgtacggccggaggctgaccacgccctgcatcgcgtcgacctcctccggggagaacctgtccatgaacgtggcgacgccgtcggtggccacccagatgtagccgtcggacatcatgccgagcatcttcgcgcggcggaacagcctcccggcgacgttgtggagcatgtgcacgacgaacacgcgcgtcggcatcgccctgaggcggtacagcagcgcgtcgaggcggtcgtcggtggcgtcgacgggcaccgccgtgcggtccatgatcttggcgccggcgccctgcagcgcgtcggcgagcgccgggaggatgccgctcccgtacggcgagtcctcgtacacgacggccgcggcgcgccagcggaaggcgtcgaggacggcggcgacgggcgcggcctggaaggagtcgttgacggcggcgcgcacgaagaacggcgtctgcgcgggggacagcgacggcgaggtggcggagtaggacagcacggggacgcgggagtggctgccgatgtgggcgacgaactcggtcgctgccgagctcggtggcccgatcatggcctgcacctgcacattcttgatcaggtccaccgctgcaacgacagcaacaacaacgagcagccgctcagaaattggagccaagaatttcgcagttgagactatcaattatgaaagttgttgatctgacagttatttcagcttctaatctgacagttcttgagactatcaattgtgaaaagagttttgataccgtttattgcatcattaatcaacttgatgcatatcacttattattgattactggtgcgaagtcaagtcatttctagcattctaatcagttattttttcgaaattagatcatttcattgatatggctttctttttttaaaaaaaaaatcttaaaagatgaacaactctacataacagaagaatcaaaacaaaagcaactattcagtggggttcgatgcttgatttgaacaaattggtatgaacagatattgggcatcaaaacctaaagaaagaacaccaggttcttctttcggtgagacgttccttgacccagatttagaccagatcaggcaaaaatggtactccctccgttctataatataagggattttgagtttttgtttgtattgtttgaccactcgtcttattcaaaaaaattgtgcaaatataaaaaacgaaaagttatgtttatagtactttagataataaagtaagtcaaaataaataaataataattctaaattttttttgaataagacaagtggtcaaatagtgcaagcaaaaactcaaaatctcttatattatgggacggagggagtagcttaggtgcaaagcagagtctggggtgactggactgcaactacgattctattttgttccttcagtcctcctgataatacacagtctacactaatattaccctaccagataattatacactaacacaattggcagtcttgatcatacgatgactcataatattaccctaccagataattctactccagttagaacttaggagtacagtagaagcaatggtacagtgtacactacacagttttcatgaatgctactgctgggtgctgacatgtgatactaatagacaaaagaacgacttgtcacaaactgaaaaggaccttgtatatctatacaaattatggcattttttcagggccattaaaaactgcacttgaccatctctacagtaagtctatggtctatgctggagccaatggcctcactccacacgctttggaaaattcagaactccacgtcgtccaaatccgatcgcgcaaaacgcgcaaatggcacaggtttctcttatccctacactacacatactcacacagacgtctgcatcttcagctaaaatcttctcaatatcgttgtcagctgatcgaagttacttggttagaattatctgcttacattcggaaattagattcagttttacaacttaaggacgtatgcgagagttttaggtcagcaacgaaagggattgacattttaaaacgtcctcttcgcatccttaaattttattaatataatcgtcatgtccttcatggccactgacattttgtgacgagacaatttatttcgaggaagactttatatagaacttgtgaccagctaaacaattcaagcatcaagatttcgtgtacttgacacttgactcaaatcaagcctggtttgaacaccataaaccggaccaaatcgttggtacgtgccatcgtgattttaatgggtagagatgactactagtccaactcgaagtgattaaacaaattagaaggcgacatgcatcatgcatggagctgtagcatattgtagacaagtagcaatggaggtctctaaacaagcatatctcatatagacacgtatctactctgacaaaactgatagtatatactccctccgtttcaaaatatttgacaccgttgactttttagtatgtatttgaccattcgtcttattcaaaaaatttaagtaattatttattattttcatatcatttgattcattgttaactatacactttcatgtacacatatagttttacaaatttcacaaaattttttgaataagacgaacggtcaaacatgtgctaaaaagtcaacggtgtcaaacattttgaaacggagggagtacaattgtacgtgagagttgggggtctatgactagtggattcgaggttagaaatgtcagaacaatataagactgattagctgagatcctaatacagaaatgggattaccaaaaacaattaattaatgtctaatctgtcctcctgttccggcgttgatttgaagacaaggtggcatattctcttgacaacatcagttgggtcagcatcaaggaagacaacaagaccctttgcatgcgagcatatcattgcaaaagcttaataagggttttaattcaacgttttcaagagaaactattatgatagaagggagtatcagcgacagccaaacaaaagaacgtacatatctacataatttcaggagcacagttgacaatacaacatgacaatggcagctatgaagctttttttttttttttgcatcatctgcatcaagatgcttatgcatcatgcgatgtagacatatacgtacgaacaacatctactggctcggattacaaaggactcaaacccacacgcgactatataaaacgaacaaaaaaactccttaaatttgcagatattttcgacgttttgtgcaaattcacccacatatgagcagagcagagcatagctaatcaggccatcagcaattgattctaggaaatcgctgcgaactatccattcaagccgtcaaacaaactaggcgtcgtaataaattagtactagtagtagtctaagcatcattagttagttgattagttcgagcaaggaatgggagaggcggcgagcttaccggcggaagcggcggggaggacgtccccggccgagtccctgaaatggagctccaccctcgtcgccgacccggggttcgcggcgtagtagtcctccaccgccatctggatgccgacccgccgcctcaccccgaccgccgacgtcaagttcaggatcaccccgacccggacgctcgccgccgccgccgccgccgccggcagcgcattccgctgggccgtgaccaccgggctccccgcgagcgccgcaaccaggagcgggaggaggaagaagaagcaggaccgcctcgccatctacacccgcatcacaatatcaggctctcagcaaccaccacttgcactcgcactagcagttgcagatttttctggctctcgccgtgcgctgccgccgcagtccaacgcggcagtagctttatatacggataaaaattttacgggatagtttttttttcaactagtccatccgattaagttctaaatttgacacgaatgctaattattttttcagtaataaacgatatacccgtcgacagcaagacatccatgataactttgtcaatctcaaaatatgtcggtctagtctcaatgagatacctatgatgaattcgttaatataaatatatgcgcatataattattctttcagtggggtagaaaacgtactcgtcgacagcgaggcgttcgtggtgacttcatcaatcttaagatatgtcaccctagcctcgacgaaatgctcgtggtaacttcgtcaatttcaagatatgctgataggggggggggctgtgtttatataggtgagtgtgtgttataagtgctgtgtttgtgtttctaaaaataatacgggacttttccgtcgcttgcattgttgacttgaccttgctgcgctgctcggtgagtgcgtggcaccggaagaaccggtcggaagggtcggtggaaaggaggactcgaggtcgcgggacatatggtctgtacggggaaaactcagcgaccgagctaccgattaccgaagccaatggtgatgttaatcatttctttttcctctttgtctatacttcttaatctttatttggtctgggcttatgtgttggtcagttgactctgattgagaagaagaaaatgactcgagttgcagttaatgcctacaccagatgatatgtgctgtaaactgtaagtaatatgctgcgattttacaatgacgagctgatgggctacaaaacaattggagctagtttaacagttgccatcagtgggtacgcgctttggaacaggtgtatgtttgacaatgtgggcatggattttgagctctcaaacgtgcagaattccagttctctcttccttggctctgttattcttagcttagtctcattgaattattcgcttcatgcgtgcattggttatttgtcaatgtttttttttctcaaaatatttaacttaccctaatataataaataaataatccgtagtaataatccgttccataatctagatcaaacgtgcccttggcttgtgagttccgattacagaagtattggaacaatgctgcctgtaccttgctatgaagaccttgagtccttgattaccttgctctgaagaggatgtcttattgcaaaaagtcaagaaaagcagacagaatcttccgctctaaaatggaacgagcatctgaatattctacacagtctgctgagaagaaaactttttttatggtagttggaaatttcgatctaacagaacattttaatgtgtatacctacccggtcgcttggaaatctaggacatagttctaaaaaaaagaaatctaggacataataatggagcattagatctgtaagcttcctcttaatgtaagcggctaatgcaggtcacaactcagaatgccatctttttagatatgaaatattacattttaatatccggcctctgtatcaattcatgaggcatctccctctaaaatttaattttaaagtgattttacagttttgagaaggtatcaaaagaaaatatatttcctagtgtaaagtttgatatctcttaataacttttaaggatggtaaaatttatgtaaatagtactgtgaaccgagcagtgaacatatttatttttggaaattatgatagtgataaaaaatgatgaaagaacaccaagcaacgtggtaccgaaatgaaaagtggaaccgtggaaaggaacagctgatatttccttcagttgtcaaccacaagttaaacacagtaatgtcaaactttgttccaatgatttttcaattagatctaactcccttgcttctaaagaaagtaattagtttgcctattagggacgcttaccactcacataaacagatactctactagcaattgtaatctcaacgtcttagacgttcatgctactgggaaattaatatatatagttgagttgcaatgtcaatgccattgccacttatgctgggaaatatactattcatagatctacctgtaataaaaagaaacagacttttatgcgcaaagtcagctttggtaggatagtatattttcacggttgttagttgcccattcgtgtaagatcttgaccttgtgagtcacattcaaagcaatcttcatcatttctgactatggcataatcttacaaaaccgtgaatgatcaaacaatgttggtcagtcatcacttgtgtgtacgcgatagaaatgcggtgaatattgaaagaattttctggagagcataccaaaataagacaaagttgaggcatacttcagtctgcctgctgcaatttcccagcatttccttcagagaaagagactactgatctttgaattcatctggcaaaaacagatccgtcattctagtctggtttaagtattctccatgtggtcagtcacatcagtctccaagtaagacaggcgaacaaactgtcgcagttgttgtgcctgcagtagtttccaccgtattcccttcctgtgaattctgatatcgtcatcttgaaatgatctaggccgtgtttagttcaatttcaattttttttaagtatacggacacatatttgaagtattaaacgtaaactaataacaaaaacaaattacagattccgcctgtaaactacgaaacgaatctattaagcctaattaatccgtcattagcaaatgtttactgtagcatcacgttgtcaaatcatggcgtaattaggctcaaaagattcgtctcataatttacatgcaaactgtgcaattgtttttttcgtccacatttaatgcttcatgcatgtgtctaaacatttgatgtgatgtaatttttgaaagtttgaagggaactaaacacagctactcttaggggtggataacgagccagctcggctcgtttgagctcgttgtcttaacgagccaacttggctcggctcgttaatgttaatgagctaaaaggctagctcggcttggctcgcgagctggctcattaggctcgttaacgagttatatctcattaatatcatattaataattacaaatttaacattttattatgtattaacataataataaacactaactaatataatactcactaaatatgaatagttttgatgtaattaaaagactaagcactagtcaagaaatactaagttcatgaagatatgatgatattttatactaacgagccaaacaagaagctcgcgagctaaaatgctagctcaacttgactcattaagagtacaagtttgaatcgatccgagccacgagttttgagctttttgtccacccctagctactttggccttgtttagttcccaaaaacgtcacaacgaatctttgaacatatacatgaagcattaaatatagatacattaaaaaattaattgcacagtttacatggaaatcgcgagacgaatctttttaagcctaattagtccatgattaaccataagtgctacagtaacccacatgtgctagtgacggattaattaggcttaataaattcatctcgcggtttccaggtgagttatgaaattagttttttcattcgtgtccaaaaaccccttccgacatccggtcaaacgtccgatgtgacacctaaaaattttcttttcgcgaactaaacacaccaaactctgaacctagtacaatacctgaaagctaccctggcaggttggcgccaaact

SEQ ID NO: 69606 - DNA, 1173 bp, Oryza sativa
  unsure (1)..(1173): unsure at all n locations
cacatcaaatgtttcaacacatatatggggcattaaatgtagaaaaaaaccaattgcacagtttgtatgtaaattgcgaaataaatcttttgagcctaattacaccatgatttgacaatgtgatgctacagtaaatatttgctaatgacggattaattaggcttaataaattcgtctcgcagtttacatgtgtaatctgtaatttgttttgttatcagactacgtttaatgcttcaaatgtgtatgcgtatacttcaaaaactttacacccaaagaactaacacgtaccttctgtattttttactgtttcgcaatttatcgttcgctgcagagaatttggtgttagagtatatagtacgaattgagtcaggaactcaggatccagtgatccatcaagggcaccgagctttgcatggtaatttccattaatgctattttctacgaggagaacattagatgttttttcgcaaaatctatttcgagaggcatctcgatttagacttaacgagcgacgcagacaattacgtgagaagtactattagcgtacatgcatgcaagtagtttttgctattaggttgtgcatattttttttcttcttatgaaattttctattaaattacttatccgatctataatccgattacatcgttgtgttcgtaacaattaaatctttacaacaagatctcatatgattatattttgatgaaaaatcacaaattacttttatgatatgtttaaattacttttagatttcactaagttacttcttagacatacaaaagttaattcagtaaagcctaaaagtaatttacatatattatagaagtaacttagaacaaaacgaatgtaactttgacatgtcatttgaagtaaatccgttatagagataaaaacatgactctatctagaaattaaattaatcagcacaaattatggaattaactaaaaacaataataaaagtaatcacctcagagcattatgaatgtataggaaatattttaatcaaatctaaaagtaacttatatatatgataattaaatatatgataatttgttcaatgaaaaaaggtattaatcaaagttactttctatcttttttttataagttacttctataatatatgtaaattacttttnnnnnnnnnnnnnnnnnnnnnnnnnnnnnnnnnnnnn

SEQ ID NO: 69607 - DNA, 17745 bp, Oryza sativa
tacatgtgaaaatatcaaatagcccatgcataaggctctgacctgttcaaactcagaggcccaaccattggaaccatattgctgctcaaaagaatgagcccactcttcagggttattattttgcttgccaaactcagttatccatttgtctgcagcattgtgcattggaccagatctcatggcgctttgggactgattccaatactcctccatctctgggtatggtccgtgcatgggtcctttcattcgataattactgtcgatatcaagtgaatgcagcaatgtgtttacctggtacaggtgagaagtgtcaaattaggtcacagcagagaagataaaaacgaagccactgcaacaatctaatgaaatgaaacacaaatgcaagtgctttagcatattcactgaggtaacaaaaattataagttaacctgtgcttggatatattcttcaggctggtcagccaaaatgtggcgtgccataatgcaactacgatcacgtatacattgcttgtcactttcagacaaaccaagcgctggtactggaacaggttgaaatggcacaccagcttgaccacttgctaggaaagaacgtaggacaccagataagaccctttgtggtggacctgaaccaattttgggagtcagtataatgtgcttcagtatgttatcaagtgatgaatatataaacaacaataaaataaattggaaagaacaaaaactacaaatctaccatccatgactggtggtccaaaggttggccctgtgctgttaaaaatttgctcaaattctttaagctgtgcatctggcacagcaaattctgggagtcctggaggccgaaaagattcaacccaatcatgagaaggacccccacggatgaaatcagcgccctagaggtgttcaattatagttagaaatgctcaaaagggcaccaaaagcagcaaaccgaatgaccattacccgtgcaagtggcagttgatcttgcttgaactcattctctgaaccagggatggtcgataagggagcagctgtccctaattcagatgttgttggaacattaactgcagaccctggaagttcctttattgactgcacaaagaaaagggcacatacaaagttagcttgattattaatgcaatctggatgttaatcaccccaactttctactttattacattagaacagcgtaatcccaaatttccgcttcattgtattatagacccataagcattattgtctggaggatttaacttttaactttttaaggtacaccacttatatttggaacatccatttgcaattatatagtggctagaattgaaaatgacctattactacctaggaggtaaattagtcacctatggttattactaccttggagtaggtaagtttctcctcaacatacatctaagaaaaggaatcagtatgaaatttcttgtggtgttttaagatgtatttttctgtcgatgatgacaatcttttagttcaaatgaaagaataaaacaaatctgtctttcacactttagcatgaaatctcttgtgatgttttaagatgcatttttctgctaatgatgacaattttttagttcgaatgaaagaataaaacaaatgtatctttcctacttccttggaagttgaattggaatcatccagaaacagtctaatttcttgtgatgttttaaccataaaaagcgttgaaaatattgtacaatattcatggacaatctccattgcatatatttgcaatccggctgataatggaataaatacatatatcagttgtgtctagggtgtcaatgtgtaatgcaaatgttggcttaagggaagtgattaatcacatttagagcgttgcaagtgcatcccttttgttccatgaagggctaactgtttccagttggttagtagtatttatgccaaaattgaccttcagagatgaatggccatgattaccatatggttcttacagctacaggaatcataggtgcaccataaaagagctcttattaagacttgtaaaagaggtaaagataaactaggggttgacgcgggccaaccatgcacaatccttgtcccacactagtttaactaaatggactaagtttcactatttagagacacctcatgatctacttacatggatcatggaaagcactgaattgtaccaacactttaggaacaggcatgtacttttcagctacttcaccagaattgctcaggcaacttcagttccaatctaggccaaaaccccacagaatcataggtaggcgacatgacgaaacacagataaataaactagccaaaaatcagggaaatctatactaccactcgctgtcgtgaattatgataggccatctgtcacccaccaattcacttactgcacaattttatcagatgaagcagcatgatcaccaacctaaacatcacaggatcgaactaagtagtaactaaatacatccagaccaaaccaacagtacacaaacatacatcgaattacttccgttttaacttttaagaccagtcaaacgaaattgcgtcgtttccaccaaacaatcacatcgcggaggagaggaaaggggagcgacctaaacggcgccggaattgatccatccccaaccatcaaccagccacagccaagcctccgaaccgcgagcaaaaggccagtagtagtagagagcaagtgactagggctagggctaagctttacctgcgccttggacgactggccgaagatggcgttggcgaggttcccgaaggggttggacgacgacgccccgtccggcgcgcagttgccctgcccggtgatgaggtgccgcatcgccatctccgccgccgccgccggcgagaggcgttccggtcgaggtcgaggtcgaggagagagagaggagtcgtgcagcgtcgcggtggctttgtgggaggggagtagtagcggtaagcagttggaccccgataagaccaggacacgtgaaagatcgtgctactccatatacgtatggctggtttggttggttgagaataccttttctttttccttcaaataattttaattttaatttaattttatctttgtttgtttttttctcgcggtgaaaacttttgttttttaaatttagtttctatacgatgcgagaagggtggagacaatcgattagttttaaattcgtttcgttaagttccacgaaattgtgaccgaattttctgagagtctcctaccactgaataggagactttgtactgtgtctcacagaaataaattttgtccggttaagttccacgaacttcccgtagaatatcagagattcgatattgggtgatctttttatattgtagattgtaaatttgtcctcatgaattttgacattttgtttattctatttgatcactcatcttattcaaaacatttttacaaatataaaaaacgaaaaaatatgcttaaaatacattgaataataaagtaagtcaaaaataaaataaataaataataataattattttttaaaataagacgaatagttaaatagtaagatatgggtacgaaatttccgagggagtgagcggaatacactgtaccagcacaaggatttcctctaagcccatgggggcccaagtaagcccaattggcccaacacgagacgcatacgtacaacaaagcccgagaaggaaacctaagcacaacccaaaaccctcccctctctctctcgcctcaccaccgccgtcgtcgtcgccgccgccgcaaccctcgccgccggcgctaggctcgcgactccgacgatgtcggcgccatccgaccccgccgtggccacccacccgcaggcgggcgccgccgcggcggcgtcctccagcagcggcctcaccttcaagctccaccccctcgtcatcgtgaacgtctccgaccaccacacccgcgtgaaggcccaggcggcgtgctccggcgacggggcctcgtctgcggcggcgggggggcagccgccgagggtgttcgggtgcgtgatcggggtgcagcgcgggcggacggtggagatcttcaacagcttcgagctcgtcctcgaccctgtctccgggaccctcgaccgcgccttcctcgagaaaaagcaggagctctgtgagtgaaattccggcgaatcttctgcgctttttgttagggtttcggcgaaatctagtggtacgagggtttgattcgtgattgcggttgtggccgtgcagataagaaggttttccccgacttctatgtgctgggttggtactccactggaagcgatgtgcgggacactgatatgcaaatccacaaggctgtaagttcttgttctgttcttagggcaagctagcagaaagaagtaatctatctggtcagcaagtgcccaacctgtctcattatgacaatgtgcttggttgtttgctctttttacagaaatagaatatgggggcttggtgtaatgttgtttagttggcatggttggcagtgctagcatctaatatctgtggggtttctggttgaattctgaaagggatggtagaagaggacatggttttcctagttttgtggctacaccaaattatattgttatgaacatatactgtttattgttatgttatagcatcatattgggtggtggagcagatggtaggcgcataccgtgctatttatggaccaaagaatgttactatgtattcaaatattcaaattgtgcgatgcaattattctggccatataaattgatgctacaattttctaaaatatctgctgtagtcatgtgtcatgtattccaaaatgttttatgccttctttcattgccaatttgccagcagtagcagatagtagtgcttatgttgacattgcgtacatatattctctatgttgtgtttttactcaagtttctgttagcaaatgaaataggcatgactgttaactcttttataacctcattgcttataaacatatatattcttttgagatctgctctgtacattgtttttgttcctctttgtgttacttacttcttttttttattatccagctgatggacattaacgaaagtcccgtttatcttcttttgaatcctgcaatcaacctctcccagaaggatctccctgtaacaatttatgagagtggtaagtgaatctgacttcagcttgtatcattataaaatatattgcaattgatttcacagtttttatatggtttgggtttttgttttacttttaggtgtacgtcaattatgcatgtacctgagatgtactccaccttttacatattgcccactactcctagaagtcttttttcccccaaatgccaccttttagcatcacgtatatagcatgtgtgaccccttgatttctcagataattgactcaaaccagttcggtgttctttcatggtgctactgttattttattgttccatttctccgtctgtttattattctaatttcctctttaccattttctgttatttctttttttttgacatgattttctgtaatttcaagagttgcatgttatcgatgggagtccgcagctcatctttgtcagagctaattatacaattgaggttagtttttttcttgtgtgtgttgctttttccataaataatttttgttaagacttaacgttagtacgtttgatttaaagactgtagaggcagagaggatatctgttgatcatgttgcccatctcaaaccatctgatggtggctctgcggcgactcaatgtgagggttcttcttatcatcagtttatgtcttacagatattgagttgtactacccaatatattgtttttggaaaaatgatactgacagatatatttgagcagtggctgctcatctgacaggaatacacagtgccatcaagatgctcaatagcagggtccgtgttatccatcaatatcttgtttccatgcagaaaggtattttttgttgctgttgagccctcaaaatatgtctgctattcgatgtgcttgaaatatagttcaaaatatgtttgccacctgttacttcaaataggtatcaactgtaaatccctttaccatcactgcaggtgatatgccactggacaattcgctgcttaggcaagtctcaagcctagtaagaaggctaccagcaatggagtcagaaaaattccaagatgacttcctaatggtctgctaacttgataatattctctttatttttgtttatcaaccgttgtccttcatgcagtgatgatcttctctgaattttcaggaatacaatgacaccctcctcatgacttaccttgctatgttcactaactgttcaaggtatgcccccacttattatgcaaactacaaagccttttgatatgaaagaatgtcacaacatcaacaagataagattaaaaaaatactttatagggaactcaaatcagcttgtgatttgtacacttcaatgtattatcagcaaatttaatagattcactaatgttagtaaatccgtacttgcaaatgaagttatctgccaagagatgaagagaagttgaatcataatggttgtttactcgtttggcattgcacccatgtcagtgtattaatactcttgtaacttgcagcacaatgaatgagctggtcgagaagtttaacgcgacatacgagaggtcgactgccaggagaggaggccgaggtgctttcatgtagattttcccccttctgcatctgcagctggttctctgctgagattttggaaatagttacccatatggccaggaagtttttgcgtataatctgttaggaactatatctggcagccatcaagtttcttccaaactcatgctccctcgttcaggattgacacggcaaacatgttgatattcttgattctgtgcctagatcgttgtttattcctcattcgccaagattgacatgtaaagtttatccccatcacccccatggtagttacactatttgactccctaaatggatatggatgcaggtttcctgagttatgcttgtaaatttctttaggttaactgtatgtatggctgttggtgttcacgcagcttgaggtgatgtgatgcgttatgtatggctgttggtgtcaacgtagctcgagctgatttgatgcgtgattgactgatggtcatggcaaaattaaacgggactgtctatacatcatttaatagaaaacccccataaaaatcttgcaaattgcagaccacccgattactttaagatccgtgcaaagaaacacaaccctaaaaacctcctcatcctcctttctccctataccgtgctgccgctccctagcgtgatccgcgcctttgttgccgccgctcggcctcgctagttggccagaaggcgtcaacggcgccggcgagcacccccccccttcggccagcctcttccccctcccctccctcctcaagccaccggcggcgagatgcccccgccgccaatgccggcccaccgccattctccatcaccatggcttcggctccggcgcctcgccggccgctcgttccaccacctcccatacccatccctctaaacccggcaaccaccctcttcttcctactcccacccccaccccaccccaccccgggaccttaattagtcggtcctctgctggagtttaggttgtcgctggcgccggagaagaagaggagatcaccggagttggaaaagaaacctagagcacgaatcgcgaagcacatccaatgatacaaaatttgcaagatttgtgtatgcgttttctgtcaacagaagcttaacaattccgtttacggtggcgaaatgacctttcatgtttcaagctaatgtagatcatgaagctgagcccgaaaaaaattccaagctactagaaaacaaagacgatgaaaaccaataaatttccaataagaattcattactttattacaggacacaagcagccgaccaatcctaagaacagctccttgtttacaatctacaagtgcaaagaaaaccaaccaatcctaagagctgttccttgtttacaatctacaagtgcagagcaaaccaacaaatcctaaagaacagccccttctaacctacaaacgcaagagatgttccacagttatgttacagaacggatgaaggaattacagaatcaaacccgaacgacaatcttcggtttattgccttcgaatgtcaggatggcactgattcctgcagcccatctcgcaggcgttgccacagactgttaatccaggctttcgctccaggagctccgcgacagttggactgcagccacggcgttccaacatgttcttcccaacaccaagccacctcaggcccctaaaaaatggcggctcaaatagtcccaggaaattacgtgacagcctagaacaataggagagatccagcattcttagggaacttttacccaaattgtgacgcatagaacctagagtttcaagagaagaatcattgatgaggaggcagttccggaggcagaggctgctgatctgctcgcagttcttggcaatcaacgtgacagctctgcctgatattctaggtacattcccgatatccagtgagattagagttttgttgatggtgccactcccgcacaacaaagaagctatgccattgttgctgatccttttgcaacctctcaaacataatgaagacattgggcaccgcccattaccgagtgcagataatcctgcatcggtaatgtcagctccagcaagatccaatagtgttagcttcgaaagctgcgaaatagaagccaacccagagtctgcgatgctcctgcaacctgataggtctagaacttccaacttggtgcaggatgagagtgagatggctgtttcactggttaatagactacagcacagcaacctcacttccgtaatctttggagctgcctcatcaagatcaagacatgtcaaatctgacaagtatccagtactgacctcaaatttcttcaggtccttgcaagactgaagaagggctgcatacccagcatccctcactttagaaaacccagcaagtctaatggttttcagttgcttgcatccgtcagcaagcatcattatcccaaagtcagttacccttctgaaggtggacgaacaattctgcttaccacgtgtcagagataaatgtgccaggttgtggcataacccaagtgcttggagcccaacgtttgtcaggtcattgtgcaaatctggttctttcattgggttatcttctaggcacaactcaactaagttatggagactcccagtgatgaacgcaacaagttcatcagttattatgtcaagaactaaagagagtgattctagagtgttgctaatagatgtcttcagacttgtgcttataggaaatagcctctttgcctgccaattcgacacaggctgtagcaatagtaccttgatggtactaggaatgggtaccaatgactcaaaatcaacggagcctggacctagcagaggaaagaacttgagtgaaagattctgcatggagagaaaagaacgtcagattagattatccgaccagattaacttttcaaagagttccatgtcattgttaaaataatatggctaatattatgttatctatactttagtattcacacattctcagcctaaaatattatttacaaaatactatattgctatgaactgaccatatatgtacgcgaagaacagtattggggttcatctgcaacaaagattcctcacctccaggtaaccgcatcctttgacgatgtgtgctatggactttcggcagatcccgaaatgttcatcatcatctgaagctgccatctccagcacaaatgatctggatataaagagaagaattcaacatgcttcaatcgacatcatttgggccaatatacaacctatggaatgtacaaatcaatttcccctaatgtttgtcacacaaaaacaaagtttaaaaatcaatttcccctaatgtttgtcacacaaaaacaaggataaaccgagcagtgtgcacaatatcatgcaacaaattcatcaattcgattcccctgatagaatacaatttcgtgggcaatcgtgcacacagaaacaaagccaacgctgaaggaagaaaccacacctcaaatttttgcatctctcaccaactgccacaaagaggtacgaggagaaggacgagcacttgagcagcgagagctcgcggaggcttcccttcgcgatggcgcccaccgcggagtcatcgaggaggctgcagttgacggcgaggcagcggagcgcgccattgcccgcgagaatcctattcaggatggcattcgtcggcgggaacatctgccaacaccaacaccaagcgcgtttagggggggaaatcgatttggggcgcgggggggaaaggggaagcgagaggagaggatggggggagggattgagagatgagccccctcaccgataggtcgagggaggtgacggcggagaaggcggcggcggcggcggcgcggagggcgcggcaggacgacgcggccgagcacgcggcctccagctccagcctgacgaccacctccacgaggagcgcctccgggaggctctccaccaggccgcgcgcggcgctgccggaggcctcgccgccgtccccctcgccgtcgccggcgacgacgagccggcgtctcttctccattgctgctccccgtttgcttccgggccaggggagactggagaagcgtatagatgtgaacacgggccccgggatataccaccagacatctggggcccacgagagggttggtgtatgacatgtgggcccgcccaaatgagaacttttcttcttcttcatttgggtcgtttatgacaaacgattttattcacaaattgtcgcatgagttgagttaatcatgtactccataaattgtcgcatgagttgagttaattatctactccatttgtttagaaatatagtagtttgtgtcattcaagttttatttttttaagaataatgctactcgtgcgtgtcaacaaattaaaccatcctcatttggtttctccgtccacatccttatgttaaccaatcataattacctctctttttaatttctttaaattctccaattaaaaaactctagaagcgattatattttatgagagggagtaaatgattcaaaacatgttgagaatatgtatgccatttttttttcttagaaatatacttgagctaaattcttttacaacaattcttagaagataaaatcccatccatagcaaaaaaaaaaaatccctctaatatgacatttgacatttgtttagtctacagatgcatctttgaccatattttaaaataagtttatgatattgagtaaattttgagataaatttacgcataccactttcacgttcttaaactaaatatttaaaaattcatagatattcaaattttaaaaattcatattgtctaaaatatcgtatatttatatcctataagggagtaaatatgaacgttgagtagcattgccaagagtacaacaaaatgtaaatgatccaacattcaacaaaggccaaagttaatacaaggaaaaactggagcactgagctacatttattagtataattaatgaatgtaaacaaagaacaaaagactgaaagttataatgtacatttacttgtgtagtgaaatgaacttgaaaaaggtgtagtcaaatgaacatactagtaatacacaagtatcactgggttaactaatggctatactactagtcaatggtagattcctaggcttggacaaagctttcttcagtcaatgttatttcaatattacgtttttttctctctcgggcatgttcaatctcaggcctcaaaaccaaacaaacaatgtcaggcattcctggttaggaaaaatgcatcgagatttcaggggatcttcaggcaccagtcttcctcaggcaccaaccaaacacacccctggtccatctgaaaatctgagaacaaatttgctttgtagtgattgatccatatgctaggctatgcttgtacatgctacaaaacgttgaggtacaaaatgtttatctgccaccaatccgagaaaaatttacttcccggagattgatctatacgttttttttttcccttcagtgctccaagccaacagaacaaatggaactgtcaacaaaatgcctgcctgtagacaaggggaaatgataagtgattaagtttgtaatcctagagaaaaagttgcaatgctgcacaatgacaatatgagcgatggtgaattgatgattaagaataagcaaagggaaccattgattcaattattcgatttgtccacgaagttctaaaaaataaacaacaaagatatccacgtgaatgagcaatagctggagaagctttccaacattattttgattgataattattcgattgcttggtttgaagaataacagaagagatgggcaatagatgaaaagatgataatatttgccaagacttcagtaactggattactgaatatctcaatttgacctggttatcagtaatacgattctgtcttaccttgtgtcatcaattgattctgagaacaatgctgcttgaataaccacaagtccaaaatttcattccccatagtttccgctgtcctgtattcccaacattatttcctcactgttctcccattcagtcaggcataaaatgagtgccaaccaagtgttaactgcaaacaagagcaccattatgaaagggaccactagtatcgatcacattgaactcaaagaatctgtgaaagggacatagttatcgaaattgccatatctaaccttccagcaaccatgtatctcaaagtttgtttgtagatgatgaatcatttggaatttcgaaaggtacacttggcttatgttttaagatcatttatgttcaaattgtgtaagtcagtacttttatctcaattgaatagcttcaacaattcatttacattacataatccaacttaatacagaactatgtcctgagattactcgtgggaagctttgtaaagcaatcaaaataaaacaaaagcagcagttatagaacttaaaagccatggaaattatcaacaggtgtcaggggcacagaactttcccttaaaaaggcataatctgagttcatacaactaatgtaactcctatcgcttgtcaaaaataactcataggatttcactactccagttttttatgcctactcatcaatatcaaaataatcatcaatctggagtgagaagcacttctacagaaagtaacaactaaagaatatgtttcccgtgaaataaataaagtattatatgaattcttgcctaagcttttttgaagatgaccgtatagcttgaaattctacacatgatatttctttattctagcaatattaatcacaagaatttctagaacttttccgtgttagaaggttttgaagtaaaacaaattctccttaagagcctacctgattcttgattttttttttctattagatattaatgttcttatcttagttagatgaactactgttaaacagctgaacattgctatctaagcattgcaatttggctgcaaaaataaaatgaatgaatgaatgccaacaacagccttacaattacatgtggtggacatacagcaaaaaattccatccagcagtcaaatactcaaattatcttctggtgttcccaagagacaatatgtcctggaaggttttcacttcatcatttgaataggaaggttttcttcctattaccaatttcattatctctcttgcattcctgtcctttgaaattgatatgaggccttttagcagttggttaatagtatcaacacttggaaaccagtttttctccatgctgtctttgcacagcctgaatgccaaatcaaactcccttctctcacagaggtaatgcaccattgtctggtaaaccttagcatttggcttgcatcccctcccatgcatcgcaccaaatactgtcttagccatctcatgctcgcccatcatgaagaaacccttaataactagattatacgtgatctcatctggccttaagcctgatgcatacattttcctcaccaaatcattcgcttgccagccccttctcctgttaaccaagaactggattctcacattgtaactggcaagtgttggcatgcaacctctcaacctcatgagattccacagaccatccccgacctcacgctggccacacttatagaatgcatccatgagtgttgtgtatgtgatgacatccggtctcacccccgccttctccatttcctgcataacccgaaatgccgctcgaagttcccccaagtcacacatcattttcaccactgtattgtacgaaatgtcatccaactcaaccccatatgtctctgaactctcgaacaactgaaggacctcatcaaacagccgcgctcgcagtagcaccttcatcgtggcattgagtgacttggccgtgcgcgggcatccatacaatcccatctcgcgaaaagtgctcagcgcgtggtccggcatccttgccttgccgtacagacctatgatcctgaccacgaacccttcccgcctcccctgaggcaacgccttgtgctgctcgagtatctcctccactaggtcattccgtcgagcacctgccaggcgcgccaccgcgtcctcgaacgcgaaccggttctcaatcaagaggcggttgtgcgcgttggccctgaacagctcgtacagccgcaccgggtccctctcgttcttgatcctgaccagaacggggggctcggcaggctcgacgccggcggactccttggtggtggaggggtggcggcgccgccacttggagctggcgacggcggcgcggcaggaggcgatggtggggaagtccggctgggagtagtgcgcgtgcgcggagaacgggtggtgcgaggtccgggagagccccgccgcgatgacggtgagcgcgatggcgtcgaacgcggcgcagagcttgcggatggcgccgagggagagcatctgatccgccccgatcccgaggccgccgcccgcgccggagtggtagcgtcctcggcgtgagctaggtctctcgggggtgggctcagcacggcggcgtggaggcggcggcggcggcggcggccatgggcgcgggatgcgtaggtgaggaggagagggaggagagagttccacggctgcgtgcgtgcgtggaggcgcaacccaccgcgaagtgtcatgaactagcgggccttcttcgtctacggcccatcaaggcccaagttgatcgctgtgcttagttattttgggcgctttgcccaacttgcaatttatgtatcgctggtggtcaaattagttgttagggcatcgatgcaaattggtattttctagcagattgcggttactacactatagccatcatttaagggttttttctatgtaaggcctagatcctaaaaaaattttggccaaaaacgttacattaaatgtttggacacatgtatggggaattaaatgtgggaacaaaacaattacacagtttaaatgtaaattgcgaaacaaatcttttgagcctaattacgtcatgattggacagtgtgatgctacagtaaatatttgttaatgacggattaattaggcttaataaattcgtatcgcagtttacagacggaatctgtaatttgttttgttattagtctacgtttaatacttcaaacgtgtgtccgtatacttttaaaactttacgcccaaagaactaaacacaccctaactcatctctcctgtatttcttgttctttgcacacaatttggcatacagtactatgatagcacctcgattgacatcatgatttgtgaaaaagattgtgatgtattaagtattaaccactcatgtttgttgctgtgaatctcagcatgtgacatcatgacattaatcaaaggcatatgctgagatttgaaaaatgagtaggttgttcttcgctctgcaagtttagtctatatgtttagaagagccattggcattaatcaaaggccagtcaccattattgctttctaggaaaccatcttcgcacctgatcatcgacgccacatccgattatggcaaggaccagatatcctggtccaaagacatgaaaagtaagctcgagaaactggatgagtccagttcacagattgagagcctggttgtctgctgctgaggatggcaaggttgagctcatccctggcctgcaatcttggctttgacagcttcgttatgctgtcgaagctgctgacaagacagcgtgtttgatgagatcgagtaccgatgtaatccctgatgaggtgactaattgagagaaggtttccagtgccatgaggaaagtgttcagtttttttttgggagagtggtgaaagctgatcctgtaatgcagagcctgcaagagcttttttttttgccagtgaaggagttggaggatatcctcaggtggatcctgaaggatgcacttgcacaacatgtattcaataagaaagaactggaagggaagtttcatcaagaattcaagatatggatccatgcctctagtagacttgagacgataagcattgccaaaaaagatggtaaagtcagtgacaggtgtgaattatgacgtcaacacccttgataaagctcacaagagactgatggacattgatgtataaagagatttctgttggtgctggatgatgtttggaatgaagctgatcaggaaagttggagtaaagccattgctccgctaagatgtgcaggccatgggagcaagatgctgataactacccggttgggttcagttgctgatatgattggaaaagttgttgggcagcacataagaatcattttggagggcttataaaaagatgactacttattactattcaaccagcatgcatttgcagatgttacaggcatcgatgagcatggaaggttgctctcaattggtatgaagatatcagagaagcttaatggaataccgcttgccgcgaagacaattggtgcaatgctgaattcttgcttaggtggtaagtattggaccagaatactggaaacaagaactttcgatatagaaaacaacgacgttgacctgattacaaaaggttacagtggcctcatgacaactctgagattgagttacaagcacctacctgaaaacttgcagttttgcggcattttcccattaagttgcagtggcctgaccagacttgaaccaattttttcatgagtgatcacctttcggatcattgaattgtgagaaaggaacacttggtcggcggttcaaaggcggcaaagggtgaatatgagaaccttccggttggaaggcggcaaagtgtaatcacaacaatagcacaagcatacacaagtaagagtatgactctatgatgatgatgagccgttgaggagctgtccaatatcatggattagctgtgccctcaagttgtccacgctgtccatggtaacacctcgggccacaactccaagccaatgcgactctgatcctccagcagcgtggtttcgccaccaaccacagatcacctcagcacatttaatcatgtaaagggcacattcggttccattgttttgcttaggtgtcggagctttagtgcatttcgtctcaggaggtaggtaaggaagcagtgatgccgcaagacggcgtgcagctctcaaattagcatcaccaggactgctgtcatggtgggctaagcatggtctgcctccaaggttgcggtcaaacactaggaggctccagtgtgtaccttcacccaacagatggggatcctgactgttcactggaaaaaaggactagttttcgagaggggagtcctagcctctgtagctgggttgacacaacagtagcatctgagttt

SEQ ID NO: 69608 - DNA, 13853 bp, Oryza sativa
ccagctcaggtctcgtggtgggggtggtaatgcagtatgtttgaaaattccctccaaataagcatcgacatgaagataaaatgtgcttttcagaagatcatcaaaagtaagcaattctcttatgccacaatcgtggggattgtatctttgattgctaagagacctcataacctgttggctgattgaactccaattgacgattagcctcttgacccattcaaaaccatcacctaaccgtgaccccgtaccatgctccatggcatggcatatcctttttatgcaccattttgaattttgattccaaaaacattacgaccatcatgcccaatgaaatcttgaacccaattgggactcttctgttgctaggctgataagaggaaagataacgaaaacattttttgaacagttgcagattcagccatgtattttctgtcccatgtggggatatttccttatgatttccattgaacggaagcttatgacattgtgacgaattcatataactcccaagattatcatcagaccgcatctcataaatgcctctgttgttgaagaacccaacaagccagccagttctagcatcaatcactagtacaacgtattctgcttcatacctaaggacataatagaatgtcccgtggactggtgttgtatatagcatcattcggctatatgttaccctgaaagcagaattccacaggagccagaatctgtagtgcccctggcaatgtatgaagttctcaacaaattcatgttctgttccatcaagatatagagttactgtgttctgccaaaggaggatgaaggtaaaatagaaagatcagttcagttgcattcacaggttgaaaatgggtagatcaattcgttagcagaccgtaaattacaggagatagaaaaaaagtgatcgacgatcataccctcggtgtgagagctggtgttttctttttgcgcctgcccattatcaacactaagatacttcctccaacagcaacaaggtcagcaaattatcctctgcagccacagggaaggcgtagtaaaatcaaaataataattaagaactaaactacatcctaagaatcaaaacaaatcgtgctatggtaagaatcaaaattaactgtgctccctccagccgcagcagaaaccagccccaaacaataaaaagaaattgattttttttacaagaaacaagcccattgtggtgttctctccagccgcagcagattttttttttgttttggaatgcgcaaaagaattaagcatcaatcagccgcagcagcaatgcaccggcagcagcagaacaatttccaggagaccgacaagaaaaactggaaacaaaaccaaataatcgaaacaaaccgagtttcaaaataaaaggaatccccggccattctatgcaggataacatacaagaatggacctcgaacatctgctcctcctcaaacaaggcacaagcaagaagaagtatgggagccctagttacgacttggtgacacatttggctaatgcgaaatgagaaaatttttaaaggccatcccccgaatacccaccaaatcgaccaaacggtagctgccatcctagaggatattaacgatagagagttcacctttaagccgccttaattttcttccctttagctttgttcgccactctgttggtttttttcctagttgtttgtatttgctgctactatcctatgtgatgtaaaactcttctctatccttctaatatagccggcaattctcttgccgtttactgttaaaaaaagaaacaaaccgagttttctgattccagtgattcctcaagatcaccggcagaacaatatctcccgcgacgaggaccatacagaatagaaaggacaatgcagaagagaaaatgctgcagagaggagtccgaccccaacaaaatcaataactgatacaaagaaaaacaaaatcaaaacaagtcctaattttttcatcagaatcagctagttcagagatttcttgagctaacagttggattattctctatcaacaacacgatcttgcgacacaatgtccccaagaacttgcggcacaacgcccccaggcgatccagagcaaaacaagaagaagaaatgggagatcaaccccaagaactatagaactaaaggtgcagaacggcccgaactgatgcagcagaaaggagaagaccaaccccaagaacagagcaaaacatccaagaaacaagaattgtcgatgttctttcgaggctcaccggcggaatagtatcctccagaaactagatggcgggtgcgggcaggataggctgattcttccaaagtactggacaccgtgatcgtcgatgagtcgagctccctcggcttggttccgctgccgcgctgagcgggaacccgaagcttgaagacgattgttttttttttcctttcctttttttttccttgggaaaaatggttgtcttgggattgggcgcatctggtgcccctcttcttgataactgggccgggctaaacgagcatgttgggctcgctcagccgatccacacacccacaccctctctgtcccccaccgcgtcggccgccgccgccgccgccaccaccgccgccgccgtcgccgtcgatgcttgttcatccccaggcgccgccatcttcatcgacaggtggaacatccgccgctctgaccccgaacgatagcagcttgaacttgaagtgatagcggcgcatgccgccgagtggcggctggcgagaggacgcatggtcgagcgcgcccgtggggacgtcgtagccggcggcgaccaccgtgtgctgcctggcgtggagcggccacgaacgcgacgccgccccgtcgatgtaggtgaggtgggtgggggttggggggcaggtcgcgctccgccacccaagcgcgctttggtcgagctcgtcggtggcggcggagatggcgtcggggccatcgccccactccatgttcaccgccgcactatccaatcatccgtgccgcgggagatgatctcccggacgatgtcgcgcgcgtgagccttgccctccgagtccacggcgcggtccagccatgctcgcctcatgctcgatcgggtgcccagccgcttcaaactccgccgacatccctgcacgtcgagccacccccaggcgccgatgttgtccaccgcgctggtcacctcgaacgcctcgtcaagcgagcggccagccaccgccaatccggccatgatgcgcagtgagacgcgagagcggattgggattgggggaagggaggtggagaggctctaaccctcatcgagcgaaggtgcgggtggcggcgtgaaagcggagcgggcgagaccgatcgaggcgaggcaacggttcacgcgcgcggtggccgtgcagagcagcaccggcgcggcggcgcattggccgaggtggcggcggctggtggggaaaattgggatttcgcgtcgtggtcctcaaaattggatttcacccgaatgcaactgtacaggaggattcaataaaatatcactcttaattaaaggctaccttacataaaagttacgggccagtttaaattgctaccctaccaaaatttgctctggtagaatagcaaactaaacacctctattaaaacactacctatgctataaatttagctttgcccatgaacttgtctcttatggacatattttggcttcaatccaaataaacattttcaactttaccctaccaaaattttagtagtaccaaaacttgctcaaaatttggcactaccaaaaatctggtaaggcatgaatcctaacatgccctgcatctattacttttaccatcaatatcaaagagaatttaatttatcttgtgtgtaacaaatatcaaagagtatatacactcatggaaccaatgagtatccttctttcattcatcactcaacggtccagattgtctcggtgaaatctcaacgattgagatcgctcccacctcccacctccctcgattgcgcgctcctcttcgccccctctctatcgctctcacgcgccgccgcccctccccaaccccgactcacgcggcgccaccgccctcgactgtcgctgctccgccgtcttcgcatccgtcgtcaccgccaccgatccccgcgccaccgctgtagccgccgccctcgactgccgccgctccgccgtcatcgcatccgtcgtcccaccgccaccgattcacgtcgccgccgacgccttcctcgcctggtcgctgccgagaccttcctcacccccgcgattcccaaccctaaccgccgtcactgccaccgctagcccccgtcgaccgtcgcaccgtgccgcgccgcaccgtctcgcccttccaccaagcccccggactccaacgtcgccgctccacgccgccactccagccccgatccacgccgccgcagccgcatcaccgtttgtttccgccatgggggcgtgattccgcgcgacggctggaggaggcgaggtcgggcctgccctccatcgatggcggactccgcgtgacggctggaggaggcgaggtcgggcctgccctccatcgacgctccacgccgccgcagcccgcagccccgtcggcgccgttgctgcgtcgcttcatcgccgtcccgacctcgaaggagaaccggcttcgagtccctcgcgccgccactgatccagggctcctcaaccctgcaagccgtcgatcccgcctgtgaacaaggtaagagtgcttctcgatcccgttcctgtacatgaggaggcgacgcacagcgcgtgggagggcaggcggaggcgaggagaggcatggctgccgtctgccgggctcccgggcgcagcctcacagagctgcggcatccacgccggacggcgccgcggcgtggcggggcgcagccgcgcaggcgtgcagcacaggcgccaagcagggcaggggcagggcggatggcgcagcagcaccaagcagcaagcaaggcaagcagaagcagtagcagccatcaggccatcacgcccaatctcccatcagcagaaaatggacagaaagagaaaagggaaggcactggcatcacaaagaggttgtactttttttttatttgacaatttcagaacattgcaatttcaaagtgtacaaatttattactgaaattgcaattaaatattttatttttaggatgcttgtacattttgtttcactcattgctttttatcttatcaaactaatcaatctttgctatttgtttttcagattctacatatgtatctatcctcattagttcatatatgtgatgtacggctgaaagcttgaatcagtgaatcttgaggtatttttgagtacctacttttatatttacacttatttgcaaatggatgatgaattgtgaacttgtgattaagtgcttgtactatgacttgctgatataatgttacattgtacaatattgtgcattgaattttttttcttaattcttgttctgtgttaactctcgcgtgtggtagtttattggccacacctaaattttttttctgtcctccgccactgttcatagagatgcataatggctttaggaatcccctttgttgactaaatccccattgttcattattaaacattgttcactgtgcatggatatctgtgatgcaaaactctaatccaaagcctattttgcatttcaactaaatttcacgtgttaatctcattcgtgtggtaggatttttttttggggtttcattgttgtcattggatgagatacttcacatcttgttaacatttatcgtcaatctttcattgtaaaattgtggggaagaaatggcctatctcagataattctattgtgtcaatttttctatgtgattgcttatatctagcaaactgacttaacctttcatttcaaatgatttaatctataggacgaaaattcagattgccgaagaaaaattcaggctgacaggacaccatgtcaactgctattgtttgctgcacaatcaacgaaatttttggctgattctactaaatttctgtttggtataggtaatttcttccataatgattaccccttacaaatagtgcaaatgtatacttcgtgggtcaatcttcgcactgttgtagaatctgatgttaaaattgcctgcatccggtttacaaatcaagaaaaaaaattgccctgattactgtgccaaccatattttctttgagggattgaccaatctttttcttggaaaagcttaaccctgttccaaacgtaatactgcaaaattttgctcaatttcacatgcacaccacagtgtagtcatgcattaatgattttgatttcacggtgtgacatgcacatcacattgtggacaagtacattgacagaccagcattttgatttcacatatattcttccctgttaaagcccggtcatcctaatcgatctgggatctaagaattagatggtatatgcagtacctttagtttttcttgcaattgactctaaattcttatgacgttcagttcatataaataactatatcctacagaatagatgaacctatttttctttctctagggcaaataactgaagagtgttggtatttgagttaaccactttttacgaacctaacctgctgcagttccacaaccatggatttaaatagattgttcatgtagttcctattttttcttgtatcctacgttcacagatcatttattaaattttccttgtatcctacgtttacagtgttgcatgaatcaggaaaaatctgattgaaggatctaatatttgaggactcctgctctgctgttgactacttcactccagttattcaaggtatcaaagttactctaaaacagtattaaacattatgttttgcattgttgaaaataaacaaatgttcactgtgcattattaaaaagtatgttttgcattgtgtctttgctttaatttgaataaagaaatgttcaccatgtaccgagctggactgaaattacttgaatggatcatcaccacccttgtctgaagtaaacagtacctacaacagataatgctaattgcgaatcattcttggcaattgactgcatttgtaattgattgttaattaattttaggcgcactatactgcaaatcatgtcagctttcctgagcatttgtaatgatcaatgattaaaacaaattattattattatttatcttcgtagcagcaagcttgagatattattggcaaatcatatccaaatctctgtcaattacgctttcatgcagcagatcagagtaaaggttagcaaatcatatccaaatctctgtcagatgctattttggcaatatttccatgtattacatgcccatacatgtcaactcacaagacatacaaggcaatattgttatgtctttccatagatatcatgatagcaacaatggtaacattatcctccttagcctatatatatgtgggtgaaggagtgtgatccaaaaaaaaattactgatcctccttagccggctgcatacgactgctcaacttcaactcatcatcttggtatcgttctccaagctatctcttatgtgttggaaattattatatactttagtttgcacctattgatctcctatttcttatgtattgtaataaggcatggcatccatggatgatgtggatttttcaccacatcaagccacacctaaggagtcaatgaactccaaggatgatgcgaaggtgcagccttcgtcagggcaaacaccaaacaaggggaattattacatggggcacgcgaatgccatcatgatgatgtttcaatacatacgtgatggttgccggcgtgttgagagttccatggaagactagaagtgcaagaaggtagaaaaaggacacggtgagaaaaggaaggtgggagaagggtatgatcctcgctggtcttctcccatcgagataacaatgaagatctgcaatgacgacgtctccgatgaagcaaccgagaaggaaacatgatttagtattgtcactactgtgttttggctttagaataaaataacatttcttgtgaattacacaagaaaattcagtaaacaatgtcgttcaggcctattcagtactgcttgtgaaatgcacaaccaaattcgatgaaactttgttgttatgatgcctattcagtattgcttgtgattgagttgatttctgggacctatacaaatgtgctctacctcctgttgaactactatgtatttgtttggcacggttggatgcatagcaatgttcctttatatttgttttccatgtctttttatataaggagacatcacacaccaattgtggtttagatctcacataaataaattaggtcggccaattttctgacgttgtgtagcactattgatttctgtaactcttttgctttagatcaaacacatgtaattcttttgctttagatcgaacacattttatttgcttcagggctccattaatttaaagagctgaccaatcacatgaatattgatttatgaacatgaaagcgtataaaaaaaaagcaaatataattaacataagaaaccagtatcgctaatttgctattatgttgcctattcagtcatgataaaggagtaaaggactgctagatgtcaaacttatgtgtatggtccaaatcctgtaatggcccattaacaactaaaatacccattataaatacttatatgcaatactcaacctaagtgcctttgatctgtcacgtttatcatatatcttaaggcacagatatatgcattatcatatatctttaatatcatattattatgcattatgacatggggcacaaatatattggtatatcctattctaatattttacttgcaatatatttgatgtatgatataaattgaattaaagctcaaatgcacagttaatataataatattttttgctaaacatgaaaattttaaaaattattaaagacaaatagagttgcaccgtagcgtttagcacgggtatattactagttaaaataactcatcgagttatgatcaagcatttaatttacctcttcatttaaatcttaaattcataaagactacaaataaaaataacttatttgaaaaaactcaaatatgaaataaatctaactcttgtggatggagggaatatttcgaataaaattgccgctgactctccttttcaagcttatctcctaactccggcttgctcattggtgatgagctgatgatgggctcgagtgtgggaaggtagcaaccttcacctcctttgttgcctcggttttgtcgctctggcgcaacccccatggccgatgtctacctagcaccatggccgttgcacaccgcatagaaaagtcacatcatctttatctttttgtcctcgtagcttgaccagtccatggccgttggcaagcccaaggactttccataacggccgctgcatccgcaagctcctttgcgtccccctcccacctccaccataaaagtcttggacgccacgcggtagctcatccatacctagggcatgggggatgcttatgttcgagtgtcccgaggagtgcgtggaagctgctgggatggtgggtgccatcgtgcagctcacgaaggcactgaggtcgttatcaccattgctattggctacctcattgccaccgagaggagaagggggcaccaaagagtggtgtgtagctcacgtgacgcggctagagaggagctccgccacctcatggttgtggtgcagcttgatgtgagcgggctcttcagctcggcgccatggcatttagtggtagttgataagggcatccatcaccggagcgagaaagaagagatggcctatagagaacccatgttgttgaaagtgttattttatcgaatcctttttgcacagtggtatttaggcgaaacctatttttgagggtggcataatcccaaatttctcatgcataggggaacagaagtttgcctatgagaatattgactactgtgatgtccctccattgtgatatcttaaaattacttgtaattttatattgtttggcatgatattcagcttaaaatcacttgagacttctttggttccataaaaatattgaatgggatttagtatgaaactaatctcctcaattctctccgacctgtctcctgtaatgaacattgtttatgcttttttagtaaaaaggctggcgcagagcctttgatttataaaattctctccaatctctccctaagcctattggcccataaggatattgaaagggacttgatgtggatttaatccccccacaatcctctccggtcctttttcttgggaattgaaaatatttttgacgagtatttattaaactggtgatccttgtataaatattactgattgaaccagcaaccgtagttttattttaaattgttgatttaattcgtgtgccatgtccattttccagatatggtgagttaaagattttcctttttaagtatatagtgatttagtggcatggaatggggattggggaagaaaatgtctttgctcagaaaggtccgcacttccacaagattaactccttcatgctagcatgatatgttttatgctagcatgatgtgttgatgtttttttggttagcatgatgttattgaacaaaactgtatgagttcattaacttctcatgcctctttctagcttgtagacattgacgattaatgagaaacgtccaggggtcttccggctagctccataaggtggtgggctagatgatctgggttcgaagcctcacctcttctaattatttgatattaggttcttccctaatattcgcgtttttgacattggcgattaatttgcaacgttgaaaagcatgagtgaacgcgtgctacttatctctgatgtggcgtactttaaaagagacagcgttggagctagggaagaagcggagggggagatgccggggatggaagaggagtatggcggaggaggaaggagtggaagatgcagatattttcaacaactgactaccaactaattgtttcctactatcttaagcttcctaaatgggtctcaataacatatgtttcttttaccaaattgattaacaaagtaaaggggaaaaaacaccaataggctactgtgacatcaaatctgaccaaacaacatgcacatctatattggcgaaataatgttggatccgttgaatagaacctgcatgagtggtagccttgaaggcacaatagcgatggatttgattggatccattttcgccggcggccgctaccacaggcgtaatcttgaaatcaagaatcaacacagtgcgcagctgcacagcaaccacgaagtttctgagttttgatggattaacaatggtgccatcgaagagcttgatttcctcaggtatttgactgacaaagcaagagatggataagtgtatgccgccatgaattagcttcggaatcttaatttgtatggtgctttccttcccattgcgaagaagggctaagctgatatccacggcgccatggatgccatggatccgccgactatacaccccatgaaatggtgtaaggtcgctgaaggcggccaccccgtcgatgagctgcaagtcgtccttttcgtcctctcctttcttgatcttgaggtcgtactcgatcacagcaggattttccagcgagatgcctcgcttaggacctgacaatcttataagcgagttgggatcagagtagtggccaggcaagacgaaaggatcatcccggccgcggttgaagatgtagttgcgcagggggtcaaagagatcccgggcagccatgaagccatagatctggaccggggcgtcggcggcggcgttggacagagctgctatcttgatggagaagatttgcatcatgcggcagccatggtggacgatgcaagccgtccagcatggctggcaatggtcggtccgagccgacagcctcatcggcagcaggctagtctcgcgggtgtcgtcgaggcagtagaggctgtggaacgggtgggagtcggggtcgtagatggatccgtcgctgtgcttgacgccgatgagctcggaggcttccatcatgtcgtcgtcttcgtcgatgtcgtacaagaattcctcctcttcctcatcatactcccaattgttctcctcctcctcctgctgctggtcatacttcttccccgttttgattggagcgagggaacaaggaataaccaacgcgttcttctcttcgttctcatgtgatgacgactccggcggctggcaatcgccggcgccgcctcccttgtccatggatcgatcgatcgatcgactgaatcaccctccggctgggacgctgggtgcgtggtttgtttgggggtcatgggattagcttgttgctgccttttatctgatctgatgggaaacaaaccgtgtccgattccgaccggtgaaccgtctccgagtctagcgactccgtcgtccctttcccggttttaccgtcgtcacgtcctgtgccctggtgtttggagtggcggctgcgtcacggatcatccgactggtaaaaaaagaggaaagtcagggctgccttaatccgcaaagctgccgagggaccgacccgtggaatttgctatatatttgtcgcgtgattttttttctacgtattttgtcgttttttcgaccgtatgatctgcgccgcgatttgtgctgatttcaaaggttgctaaatgcaactgggccaccatttccttccggcccaattatccttcctccctcctggcccgacatttcctcctctttctttcctcaccccagcccagcccatctctacaagccgcctccatccttccccttagcaaggccggcccatcctcccatcctctctccggccagccaaagcaccaccaccttccttttttctccccggaataagtccactttcgatcacccacgcgagtttgaatcacgtcctttgaaccgtaataatagaaatcataaccacatctttcataactaagaaaaaaaatctttcataactaggttaaataaggtcctgagacagtacaagtgattgttttgattgatgtggcatcctagtcgacaaatagaaaatcaaaaaaaaatgtgaagcccatatgtaaagtggactccacctctccctacttatcccctctcttccccaacaactcgtcggcgacgagaggagaggcgaccagcgagcccgtttgcgtgaggtggcagttgcggttagaggttggcgatgccactggtgtgtagctcaagctcgccgtccacgggaaggtggcggtggtggtgggcaaccggagaggatggggccgcagctgtttgcaagtgaccaagtcatcgttccgcccatttcaacactactgtcaaatttaaagttagcatatctctggactatagaatagagtaaacacaaattttgtttctggtcctgctgattcaacaatatcattccatatttccatttaaactttgcagccaaaataaaacctcaactactactatttaccctctcaacctccacactaaagttgttctaccagcagcgcgcacactttattctctcctctttatgtcagcattgacgaagcactgtctgtcatagtggcatatcttaagctgtggtacttgctatctttcttccctgatgtttgttcagttgagcagcatgtgcatgcttcacttcagcatcagtttgacatctctgaaaaggcctcacacctgccggattcctatgacaaaaaaaaaaaaaaggatcaacaatggctgaaggataatctgctccaggcttcatctttcacgcaaaaaataactatttttcaatcaagtttttatttttttaaaaaaatgttttcccattcatcaacatcagttcgtttcattgccgtttattaacttcagtgctggagtgattttatagtctttaagggtaccatatttccaccgtacatttgatatctcacggta

SEQ ID NO: 69609 - DNA, 996 bp, Oryza sativa
aatcccccccccccccccccccaaaaaaaacaactaaagcaatgaaattgatgaaaaccataaacttcagatgctacgaaaccattttgcctaatccaatatgaatgtggtgcgatttggagcaatagacatcatcgttgttcatgaaatgtaccgtagacaataacatgatataacctagaaaatgaggagatcctttcttgcttccaaaactctctttcctatttgcaaattatcacatcattgatctcacaccaatacaagtagattatctagttcatcagttctaatcccaatctgccggccagaaaaagctgaggatcctatgccacgtacagacagcagaggtaaaacaagcaacccaatcaagaagctggacaaagctgtttgccacaaagctcagctttggcctcttgtaatcatgtacgcaagtacggaggttaagaaaaaaaattctttgtgctaatcatgctgttataaactcgttccgtcacaagctagcacacctatatgagataaacatcccgtgtgaaagtatatcctgcgccaaaattccttaccacattccggtgtttcaagtgtataatcattaccttccaatttcccaattatacttacaagacacgcacatatattacacatgctaaaaagacataatccaaccacaaatattctgatgtatgatctcaccacattactacgaaagcattatcatccggagtattatgtttggtatcgaaggtatcaaatctggtacttatgatgatatcgtgcaatggtataccattcgtactcgctctagtaagtctgagaaaagaagatcgagttccttcacaaaaatagagttgagacattaggcgtgctgtttcagtttattatccctgcatctgcgtatttggatacatgaataaattgcattcagaattagaccgtgaaacgaccgacccggcgagattatcttcttggttaactttggtacgtaatgagagaaacatg

SEQ ID NO: 69610 - DNA, 10462 bp, Oryza sativa
  unsure (1)..(10462): unsure at all n locations
attcctgcagcccatgtctatatggtggtgctatcgcaagcggaagcatttgtgatttatgtgtaatcagtttggttactggactagacaatgctgccctcccagttataagttgtaacatactagtgcttaccaacaaccagtatatctctgtgctgctaaatggaaattgagatgacacccaatgttttaaacaaataaaggccagtatagcattctatttccaggaattatttaggcttggctctgcaatgtatttccttccagcctacttggtgcatgaggtcatgaaatatggtcttcaaattgaattatagatgaattgtgatgctgatattccttgtttttcttttcctttttcttcacagggatcttccgtcggatagtatggtattgtgctggacacactgttgactttcgtctctatgattatctctgataccgatcggagcattgcacctcttccttcgatcaatgggcattgtgaaggtagcaagttgtgcgcctacagaagagcgggcttacagctgtggagacgaggacattacacaagaggagaaaatgctgcttcagagatttcctattcatgaatccgatgactatgaacatgaagaggtcaattgtgagcttgcaaagtctggagatcagatctgtagtgtcccttatgggctttatgatttgcctgaattgaatgatattctttctttggagacatggaacttatgtctaacagaagatgatagattccgtctagcagcctatctcccagacatggaccaacatgatttctttgtaacaatgaaggagctgtttagtggcagtgacctgttctttgggagtccagtgaagagcttcttccacagattgaatggtgggttttattctccagaagtttcccaggctagagaattactgatgatctttgaaagacgaagatattatcattttctgaagtcccatcatgatggcatgattttcaagtttgcatccatggacaaggtaggaggacgatgtggggcgagtactggtcttcagggtaaggttaacagttggaatgacagaagacatgaagatcccctcacaggtgttgacataagcggttctcctttcaatagaagtctatcaattgccaatgaggttaaagatgcaacccttccacctttgaagcgaaccaaacgtatggatgggacagtaaccactcattgttcagccaagcgcaagggaatagtctacagagacaaatcaatggaaatgagctcattgaagagtcctgtctttcatgttcctggtgagcttactacatgtattagattgcccaaaggtgtgctgaaaataaagaccgattgtgcttccctcattgatcacaatgaaggaattcatcgtacaccagaaccgatgctagcagaccaactgggaatacaggtctccagcttaccttgcgcttctgcactggatgttcatggttttgcgatgaattcagcttattactaccacataaacacaagcaagagtactttgagaaatctacatgtgcgtccctaccaaagagaaggcacacttgatacttaccctcactcagttgaaagtccgtttggagtgcaaattatggttccagaggagcttaaaaggggttactattctcgaatgccgaattccttccatcagtcaacaaccaaacatagtccggaatattgcaatgaagcaccccacgagaagaaccttttgaagaactttggtcaacaaaatgccgtaattcctgaaagttctcctgatccatttacaaggaatactgattgtcatcaaacaaatggatacatgacgcatggtctgaaaactgctgaaagtatttctgaggtgttgacccttggtacagacaccgctggcccttacaaacacctattggagcagtctgaaacaatgcgttacccagaaggattgaagctgaagactcctgccagccagtcagttacagaagttgaagaaggtcataggtaccctttcacatacaaaaggaggaagctgcagaagaggcttgaccttgttgatcctgtcaagaaatcaactatggtggattcagagcctctgagcgcactggctagcgtggcaaatgtaaaaatcaaaggcaatcaagctttgaagattggcagctgagaacaaggatagctgaacatagaaattggagcatggcttatgaacatctagctaacatagtaaataaaatgttctcttttgttttgggttctggttcgaagtcaggtggagtgcattcattgttaaatttgatagtagacaaaatgacatgaatctctagtgcaaagcattcagattctctgctttctatcatgcacatccctccctgaatacctcgtcttccagatgagccgcagtttacttagatatatacattgtgttaatgtttttcttttaaaatagtgctgttgacttgcaatgtacttcctccgtttcatcatactaaaaagccattttagctttgtaccaagtcaaatattttcaagattgatcatgtttatagaaaaatatagcatcatttaaaaaaaccctatatatatacccatttgaattaggtatatactcaatttcaacaatggtgcccgggcaccatggagcaccaaacaaatttactatatatatatatatataatgatgatttaatgaaactaatttgatattgtagatgttaccatattttcatataaacatgatcaaatttatatatatatatatatatatatatatatatatatatatatatatatatatatatatatatatattgatgatttaatgaaactaatttgatattgtagatgttaccatattttcatataaacatgatcaaatttaaataggtttgacttaggataagcctaactctgtactaatgaaagttctgcacataaaatgtgtacaattttccactcatacagtagtatagaaaaaccagtagctagtgataaatgtttctttttctccagctttatctgatctcagccatccgatgcgcatccaacggctcacgttaatcacaagctttcaaatattcaaataaagccttctcccctccacgcggcgagaaaaaaaaaaagaagataaaaatggcgccgccgcctcacctcctcccgctcctcctcggccgcctcgtcgtctccggcgacctccgccggagccccgcccacctccgccgcatcgtcccgctcctcccttcccacccccacctcgccgccgccctgtgcgccgtccatttcccgctcttcccctcctcctccgccaccttcctccacaacatcctcatccgcgcctccgcctcctccgcgtccccgcgcctctccttcgccgccttctcctccctcctccggtgcgggctcgtccctgacaggttcaccttgccgcccctcctcggttcggcgggtaagctcccggccttcccgcgcacgggcgcgcaggtgcacgcgcaggccgtccggcgcgggttcttggcggatgtcttcgtcgtcaacgcgctcctcgcgatgtacggcgcgctccgggacgcggcgtcgatgcgggaggtgttcgggtcgtgcgccggggtcgcggacgtggtgtcgtggaacacggtgatcggtggctacgtgaagtgcggggagatggagagtgccaagagggtgttcgacgaaatgccacggaggaatggggtgtcctggagcaccatggtggggggctatgccgcggccggggagctggatgtggcaagggagatgttcgatcggatgccagctattgggaggaatgtcgtgacatggaactccatggtgacaggattcgcgcgccacgggctgctgccgttagcgaggaagatgttcgatgagatgccagtcaggaatctggtgtcatggaatgcaatgctccggggttattcagtgaacagcgacatggatggcgcgagggagttgttcgatgtcatgccagagaaggatgtggtttcctggacatgcatgatttcagggtatgctcaggctggacgctatcaggatacccttgagctgtttcgcgcaatgcagactgagagcaatgtacagccgaatgaggtgaccatggtgagtgtgctttcagcatgcgcaaatttaacagcactggaagaaggaagatgggtccatgccttcatcgacaagcacaaaatggtgctcaacaacgagtacaatcttggtgctgctcttattgacatgtatgccaagtgcgggagaactgacattgctgtcaaaattttcaactccctggaccgaaagaacgtctcggcctggaacgcgctcatcaccaggttggcaatgaacggcaatgctcgggattccgtagacgcattcgaacagatgaagagaacgggtgaaaagccgaacgacataacgtttgtcggtgtgctcacagcttgttcccacggtgggctggtggatgaaggtcgacggtgcttccagagcatggcgtctacctgcggagtgcagccggaggtgaagcactatggttgcatggttgacatgttaggccgagcagggcttcttgaagaggcagaggagttgatccggagcatgccgatggcacccgatgtcatggttttcggcgctctactgggtgcctgtcgaatgcacaagagatttgatgtggctgaaagagttcagagtgagatccatagcctcaatctcaacgcccagcagtctggctgccatgttttgatttctgacatttatgctgctgctggtaaatggttcgatgttctggaggcgaggcaagttgtgcagaggtctggcatcaggaaatggacacgataggtttaagattcttgcagaagcctgatattgactttacgcttttgagcaatggaagtggtggcactggtgggtatattgcttaatgcttacaagttatcggaaatgtggttagaacatcacaactcataagccccagatagcaaaatactatgctcgttatgcttcagagctgattgaaattgccataacgccaaagatggattatgtcacagcatctgtctttacaggccaaaacttaaaattcatcagaatttattcagttggtcttgtttccttgaccatcaatttccttgagcatcaaaacataggcaaaacttatttaaatcatcagaattttttcagcggtcgtgtttccttgacccttatagaagatccaatgacaatatgctatacgtgcataagcgtagacataatcccacttcatggtcttcgagactcgtctgttagcagtgtttgttactctctgtttcatattgtaatttgttttgattttttttctagtcaagctttttaaatttaaccaattttatggaaaaatagtttcattaaatctaacattgaataattgtaatgatatgtttattttgtgttatagatgctactatgttttttctactatgtgatttataatatgatgaagaggaagtataaaatttagctgatgtgaatatgaacgaggaccgagtgttatgttgttttttggtttttgtcaggtacctactagtcctaattgtgtttttgtcaggtaatccggagtgagctgctctgaagaaacagtcgattgtttgctctgaagaaaaagttgattgttattgctaacagaaaacagatatatttaattgttatcgtgagctgaagaaattttcatcaggtgctccaaggataccaaagaaatcagctgcaaggattggacgccaacgggcaatcgccaacaaacaccagagcgagcaaaccaccaacaaagcacagtataaattgccaagggcattcgctgcaaggaactcctcccgttgctgttgatcaatttgatcagcgtgacaagatctcccattcacactacgcaatcatatgtttctgtaactgtaaattgcaaagctggtgctcgaaggtggaattgaggcagaagaatattcgcaaaattaattgatacatctaacttgcagaggaaaaaatagacaactcatgaggacactaatataatactcatatttagcaatataattaacgtacgcagttcgagaacccatagcacaatctagccccatgcattgcaggctaggtaaaggtaaagcaaatcgcacaaaataaaccgaaccgacccaacaacgcgatgttcaaaaggtaaaacagataagctagctccaatgctccatggtgtactttcgctgcgaaggatttgacgaggggaaaaaaaaggaaacccgcttagtcgacctcctccatcttgctctcgccggcgtcgtcctcgagcggcggcatgtcggtgtcggcctccgccgtctcgtcctcgtcgatgctcaggccgagcttgagcatgcggtggatcctgctgccgaaggtgttggggtcgtcgaggctgaagccggaggtgaggagggccgtctcgaagaggagcaagacgaggtccttgacggacttgtcgttcttgtcggcgtcggcgcgcttgcggagctcctccatgatggcgttctccgggttgatctccatcgtcttcttgctcgacatgtacccggccatgctcgagtccctcagcgcctgggccttcatgatcctctccatgttggccgtccagccatactcgccggtgacgaggcagcacggggagtccaccacacggtccgagaccaccaccttctcgaccttgtctccgagcacctccttgatgaccttgcagagaccctcgaatttctccttgagctcctccttccgcttcttctcgtcctcgctctcatcaagcttgagtccctccttggtggcagagacgagcttcttgccctcaaactccttgagctggccaacagcatactcgtcgatggcatcaaccatgtagaggacctcgtaacccttcttcttcagcttctccaagaagggggagttctccacggccttcttgctctcgccggtgatgtagtatatgtcgttctggccttccttcatcctcgtcacgtaatccttgaggctggtcagctcatcgccgctcttggtggagtggtacctcaggagctcggcaatcttgtttctgttggtggagtcctcgtggataccgagcttgaggttcttggagaaggcttcatagaacttgttgtagtcttccttgttctcagcaatctcgaagaagagctcaacgcacttcttgacaaggttcttcctgatgaccttgagaatcttgttctgctgcagcatctcacgggagatgttgaggggaagatcctcggagtcaacaatgcccttgacaaagctcagccactcagggatcagctcctcacagttgtccatgatgaagactcggcggacgtagagcttgatgttgttgagcttcttcctcgtatcaaagaggtcgaatggtgccctcttgggaacaaagagaacagctttgaattccagctgaccctccacagagaagtgcttgacagcaagatgctcctcccagtcgtttgtcagggacttgtagaaagcagcatactcctccttagtgatctcctcaggcttcctcatccagataggcttctgtttgttgaccagggaccactcatgagaaacctccttgatcttcttctttttcttctccttttcttccttctcttcatcaacatcctcaaccttgccctcctcagcatccttcttctcttcctcatcttcatcatcagaaatttccttctcagtggtcttctcagtccatagagagatagggtagctgataaactcagagtgcttcttgatcaggtccttgaggcggcgctcttcaaggtattccaactgcaggaagcatgagcaagttgtcaataacaaatgaacacattagagccaggacaccttatagcacatttcacagttcaacttaggagttcaggtgattctaaaaattcacaacagtagaacagtaatacttgttactaattaattcatagtactccctccgtttcacaatgtaagtcattttaacatttcctatattcatattaatgttaatgaatctagatagagagatatgtctaaactcattaatatcactatgaatatgggaaatgctagaatgacttacattgtgaaacggaggaagtattagacaaccacacgcaatcaaactgacacaaaaccagacccaaagaaaaaaaatgcatacacaatcagtttatgagctcaacaataagcttatagatcctaagtacatgtgtaacatgattactcataacatccaaggcagaaacatactaacataattttcacagcaggagttcgaaatgttaaggcatctatctagattatcacaatgtcaacagtgtgtgaaatatgttcattctgttcaatcaattcaccaaatgcccctacatagagacattttttatgtcttaaacagaccgattaagcacctggctcaagcatgcctatggtgaaaacttgaggcacatcaacatgttctttctaaaagtggctataaaatcaagtaccaacaatattcgtaataatcctacgaggacagaattactagttgatgcatttatcaatagcaagccacattcatgaactataagggcattcagcaatacaagcagcacaaattgaacaagaattcaatgaaattctgttagtacctgatcatccttgaggtagagggtgatcttagtacccctcccaagctgctccccagatgtgtcacgtgtgacagtgaaggacccaccagcctgagactcccacacatactgctcgtcatcgttgtgcttggtggtcacaactactctctcggcaacaaggtaggcagagtagaatccaacaccgaactgaccaatcatggacacatcagcaccagcagccagtgcctccataaactccttagtccctgacctggcaatggtacccaggttgttcacaagatctgacttggtcataccaataccactgtcaatgatcgacagtgtgttggaggccttgtcaggaacaatatggatgaacagctctggctgagcatccagcttgctcttgtccgtcaagctctcgaacctgatcttgtccaacgcctgcagaacacaaaagcataagataagtggccggttttgtatgaaagcagctagcaattccaattcactatccgacaataatttaataatgtttccacaccaaaagttcagctatccccatctattctcacagctcaatcttgacaccaaatgggacatctctaccctgcccaaatttagcaactccaaagatttcaggatttaccacatttttggcaggatagagaaccagaccaatcctcagttcataggggcaattttaacaatgaatcagcagagtaaagcactggttgggtgtttttgttccatagggtcaattttaacaatgaatcagcaaagtaaagcactggttgggtgtttttgtttcatagaggcaattttaacaatgaatcagcaaaataaagcactagtcgggtgtttttgtcttatatatggtcaaaccctcctatcaatttagaatgtgacataactagcaaaataaatgacaaataaatgataactagcaaaataacaaccctctatgtttataggggatatgttttacaacatttaaacatcaacactcaaagcatgtgagacttttcagatgcgactttatcagagcaatcgtaaataatgctacgagattaattagcagaacaacgacagataatgctgcctatgcctgcagttatgtttataacattctaatcagcagcaaaattcaggactcttaacaaaattaaggaccgcatgatccacagattattacactaacaaaattaagtactgcgagcatgatccacagattgatacactgagaaacgtaattaacgtcggaatcgaaacataatcttaaaaaatggggagtgaaacaccacatcgcagatttatgttgggatgatgtctcagtaaccagtaaccagtgctgcagtgcaaactccctcacacacccacacacataacaacacacacgagtcagctcgaaccagattgggtgaacaaaccgatctaccaatcggaccaaaaaaaagcccttctaacgcgcgcgcgtgcagatctgaaccagtaaaccgagggcacttacatcggaggagttggagatgagctcgcggaggaagatctccttgttggagtagaacgtgttgatgatgagcgacagcagctggttgatctccgcctggaaggcgaacgtctccgtctccgaggccatggcgctgcggcggcggcggaggccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69611 - DNA, 4181 bp, Oryza sativa
ccaactctgtgctccgccgtgttgccgccgccgccatgggctcctgcctctcctccgacctgcctccccgcgccggcgccggcgcgggagcgtcacccgggtggccgcagcggtggcggaggaggaggcagcggggggtggagcggggcggggctgtttccggcggcggcggcggcgtcttctccatcggcgtcggcggcaagaagctgcaccacggcggcggaggaggaggggagatgacggaggaggagctcgcgaaggtcgaggggagggtgtgcgtcaacggcgcgagcgcggcggcgtgcctgcacacgcagcaggggcggaagggcaccaaccaggacgccatggtcgtgtgggaggtgagccaggcagccatggtggatggcttctgagtcctcctgatcattggtactagtagcgttttccttcgcgtgttggttctgaaaatctcgcccgcctttttcctcgccgtgttgctcggttcagaacttggtgcttgcgtttactcgatctttccgaagtcttctttgaactttttttttcttcacggtattggctttggatcaatagcggatttgaattcggagtgtgtgtatattcgattcacagggaggagcgttttagtggagtgcttgattcgaaatgtgggatttgactttataacagaataagcaaaacctcttctatttttctagtttgttcttcgaaacagttcgagcatttcttgatttggtctcactgggagcgtcttcttgctttgttggatgacttaattcgaaatgggaaggattcagctttagattgttttgagatttaatctgaaaacgaggagtttactggttctttttgtatgtgaaaattgtggggggggaaagctcactttttctgtattattgtaatgtttcctgaatcctgataattttaaaagaaaatctgataaatgggacgtgttagttggaatattggagacttggagtcgtctgctcgtgcttgcgttgattcaaaactttctgtatagtccaagcgagatcctttcctgtgacccttggcaaaagcttctacctttctttgtattcttctgttagtttaaagaagagtatgattttggctgtttcttcaactagatgctcttgacaggtcaagcgattagtctggtctagtaatagctggcttggtatatttagcttatatcctaatcaactaatcgactcccttcattttcatgatatgtaagcaagtagttatgttgactccatcacacaattggtggagtttacctaaagggagtggtgaagtacaatcatggataattttcacttttgttttggacctacaactaggcagctagctaaacttatctagctacataggaatatcttgtgagcttgttttaggaagtcaaacaagtaaaagcagccactttatgatatgcatggtgatcatgctcttcagaggacagtaaagagaatttatgcctaaagattctcagtataatgctattgattgctaatattcaacgaaaataggtaagtacttctttattggagtgaggaggtacttccttgacaaatagtttccatctgttggaattgagtttttattttcttccttttggcttgggatttatattttttatattttttcttgttttgcctcgccttctgttttgaaatgtgagttataacagaaatcatatttctagtcaactttcaacatgaatatgaaatacccttatagggactgttcgatgtcttgctaatagaacctcttagcataggagtatcctcatttactaagggtcagttgcaacaattgctaatcgcatggaacaatgccttgtgagggttccatcatgggtgattggatgctaatttgataccttttccttgcctagttgctgactttatccatctcatttgtgctatttgaggtctgattatctgattctatcctatgtgcatttctcacattgttcacccaactacctgtgtctaccgttctttgtgtagggaatactccattgtgaaaatatgagcatactgaatagaatcccacaaatacagtttgttagaacccatctatacccttcagtttattttcctgaaaagtaatgtgcattgtcgatttgcttttaaacaaattaattatagacattaccagcttatcacatcactggtactaggagcgcaaacaattatctgacctagcccttccattcttgcagaactttaatacaagtgatagtgtcttctgtggtgtgtttgatggtcatggtccatatggtcattttgttgccaagaaggtcagagattctcttcctgtcaaaatacgcacactatggaaaaccagtgccaacgaggacactagttcccaccaaaatggaagcatttctggaagtgttaattcagaagagtcacctgttgttgatgatgaatggggtgaatatgctgatgacagcgagaagcttcctgagatgtttcttccacttaagcagtcttattttaaggctttcaaattgatggacaaggaactcaaaatgcaccctacagttgattgcttttgcagtggatcaacagcagtcacgttagtaaaacaggtgagggatgcttctaaacttgttctagtattcgtagataactgaccagcatttggaacaaaaaaaatagtggtagatattgaaatcaaaatgacagaagaactggacatggcttattttccagggattggatcttgtggttgggaaccttggggactcgagagcaataatggggacacgagatgctgccaataatctaactgctgtacaactcacagttgatttgaagcctaaccttccaagtatgttcatttctcacttatcatttcagtgggtacccttgtgttttcaaaactgaactttctctttaactgcgcatttaggattttcttcttttcctcctagatatggcttcagtcaaacttattaacgcactaagtatagttacttgtctggattggtcactctttttggttaatcgctaatcttcatatttcttatttaggggaagctgcgaggatccagcagtgtaggggaagagtttttgctcttcaggatgaaccagaagttgccagagtatggttgccaaataatgactctcctggattggcaatggcaagagcttttggagacttctgccttaaagattatggtttaatatctgttccacagatatcctatcgtcgtcttactgaaaaggatgagttcataatactggccactgatggggtatttttcttatcatcttattactttcttactactacttaatatggtgttgaaagttactaattccttttgtgaatagaaatgcatcatgttctccaatccctacttaatccatggggattggggaatagtttgatttaacatacaaagatgttacagccttcactccttcagctgcttcaacttgtaatattggtaaactcaatgcatgtaggtttgggacgtcctctcaaacaaggaggctgttgacatagtagccgcagctccatctcgtgcaacggctgccagggctcttgtcgactgtgctgtcagatcatggagattgaagttcccaacatccaagagcgatgactgcgctgttgtgtgcctattcttagaccatgcaaagtcacctgacttgattcaagagaacgagagcgaggaagaaactacagaggatgttgcaatcccagacaccgttgctaaggttgaccaagacattgcacaaggagatgcacatatctccagtgaagagcaaatcaccgagccagcattgcagcactcctacacattaagggatgttgatgagattgtaccggtagaggagcctccagtctcaaaggaacctgaaagatgtggatctgcccgcagccttgctgattgtatatccacaaacgaggaggaggaatggtcagcactcgaaggtgtgacgcgggtcaattccctcttgaaccttcccagaatactttcaggcgagaagagatcaaccagctggaggaagcggcgatgaacgattcccccgcttaagtcaggctgagagcgcatttcagtcgaaaccggcaatttcagccaggagtgtgcaaatctcttcggtccctgggattttattagagccgatttttaggtttcttcacccagattgtttcataccctg

SEQ ID NO: 69612 - DNA, 7435 bp, Oryza sativa
aaaccttgtagctggttacctattatctctatctctactattataaaaattgaagatatttttgctaaaattttagtgcgtcgtctgtgtttgagtcgttttttaagttcatggatcatattttgtatggaatcggacacagacattttgttaaaacggacaagggctttttaaaactgtgagactctaccaacgatggaaaccatgcaaggcaccggtgtgaaacccaatcgtaatcaaactcatggatggacatagcatccacatcagtgatcgatttagaacaagtgaagttcgtaatagtgattataaggatattaaaataaaaatcaatgtaaaactgagcacatggttaactaaaatttgcaatctctatttctatctttatcttctttactattataaaaataaattgaaaatgttttcatcgatactacgtcgtccgtattttgagtcggtttttaagtttatttttttaaatacataaagagtcgtataagaaatcattttaatatgctaacttgatatgtgagtcggactcctaattgcttgagaattcttgccacgttataagaaagtaagatacatgatatggccatcatcccaataaggatttcaaattaaatatcaatactatcaaaataaaaaaacacatactttttagacaaaacaatctaacaataatacgattaaaataacctttcacccgttgcaacgtacgggtattttttaagttaaaaaaaaggaaaatttaattgtcttgtatatgaaacctgcgcggatcgcaaatacgaccagcgaaatcggtcaaaaaaaaaaaaaccaaacatccccctgtttcccttcaaatgcgctttcatccctggaaaacgtattaaaatccaacataatacgctttccttctatgaaagcgcatatacttcatctactgccactgacgtggtgggccccaccctacatctcgtcccacaaatcaaccaacccctggtcgtcgtctcctcgagggctcgaggcggcggctatctccctcctttcttctcttctctctcgtttcgaagccgacgcgtcgcggaggaggaggaggaagagggcaaagccgccgcggggatttctagggttagggtttcgaggttgagagggaaggagggagagaagagcgggtatcagccatggggatgaaatttctgaacaagaaggggtggcacacggggagccttcggaacatcgagcgcgtgtgggtggccgaggagaaggagaaggaggagcagcggaagatccaggagctgaagaagcagcaggacgaggagcgggagaaggccgccttccgcaagctccaggaggacgccggcctcaagccgtaagcatctttgtttgctgcttcgatttcgattttttgtttcccccttttgcttcgatcgcgtttggggggaggaggctagggtttcaggagaaattgacgctggcgggagcgcagggtggggggggggggggagttcaggagaaatcggtgttggcggtggccggatcggtgggcttttgggcggcgttctagggtttcgtagttgtagccttctaggccgcttatgttttgttttgggacgcaggtatccgcggttttagttagattctgctaattggttgaggtaatttggtgtaagattactgcttgcgatgagagtttcatgaagctttagctaggagttagtgtttggatctgttcgtccaactattttggaatttttctgtgcctgattggtggggagataataatgtgcatggtgttattttttttctgcaggaggcaagagagattggacttcctctacgagtcagggttggctgttggcaaggggagctccgagggattccaagcgctgcaaccatctgccccagcagctgctgccgccgcctcttcttctgcccaagcgagtgccggctcttccaaggtatcgcgaccgtttcttctcggccatgtgattgtacttatgttagtttgcagttctaaaatattttttttggttgtgcatctaattccactgatattatcaaagaaattcgtatagtaggaagatacttggttgatgtgacagggcaaaggtttttcttagtaggaagatacttggttgattcttagtaggatgcgatgcttggttgattcttagtaggatgcgatgctcaaatgtttagctgattgttacaattcttccattatagcaaatgggctgaggttgctagattatgtgctgctgttgtaaacttgtaatatgatttctcatctttgaacttgcagaaaaacgataaaatatttgccttcttacttgtatgcaaaagcaaagtgcctcctactgtctagttgtggatcattgaataagttggaaactgttgtttgtggtatggatataagaagttaattaatctttccttgcttccatggcattttacatttttatgttgtcttttgaattgttttgtgttttagacttttagtcaagggagtataaaagtgtaaaatatcagttatttcatgcgcactatatcacccattggttgtaataaaatatctattcatcactagctattagaagataattgcttattttcttttgtttggaataatttcaggcagctgctccaggtgcattatttgaggataagccccaatctgcaaatgatgcatggagaaaactccacactgatcctcttctactaataaggcagcgggagcaggatgccattgcaagaataaaaaataatccaatcaagatggctgagataaagaaatcagtaagctatatccttcttttgatatggaattataccttctgagcatcttaactactgtcaaactcttgtaatgtcaaacatattggaaggtttataatcaatcttcccctgaacatattccctgacataacttcgtcttgtgtaggtggaagctgagaaaaagcaaaaggaagaaaagaaagagaagagaaagcacaagaagcgccatcatcacaaatcaaagagtaagaggcatcactcaagtgagaactcagattcagaggaaagtgatggcagggatgagagaagaaagagtgttcaggcctcagagcataagagagaagagaaaaggtcaagacatgataagaaggatcacggacaagattcagaagacgatgaacgaaggaaaagacggcatgcaacgtcagaagatgatgagccaaggaagtcacagaaggagaagaaaggacagagggaagattcagaagatgacaagccaaagaagtcaaggaaagaccgcagaagacatgattcagaagatgaagaaccaaggagaaaacaccagaggtcagaagatgatgaaccaaaaagaagacaatctgaggtttccggagatgatgaaccaaggagaagaaggcaggagatgccaaagcatgacgaatattcacgacggggtcgttcggatgctgatgataggagagggagacactatactccgtcagatgataggagagggagacactatactccgtcagaccacaacagtgcttatccaaagcacgacagttcagattcaaggcataggcgaccggaatatggacgcggcaattccacttctgaactaggttcagaaggccaacgaaggcaggaaagccagcagggcaggaacggccctacattcaaccgtcgacggggtgtccagcacatgtcagaggaagaaagggaagctcgacttcgtcaaatgcaggctgacgcagaggtccacgaagaacaaagatggagcaggctcaagaaagctgcagacgacgatgccaaggaggcggcatctgtgaacgcaaaccaattcagagggaagaacttcttggaagaagaaaagaagagcatatttggaaccgagaaggggcggaagcgccacgatcgaagagagcatccggcgccgtgcgtattattcgcagcgtaatgcccatgagagcaatgcattcaggcggtgaaatccctgaagcagagcagcagctcaggcggcctgacctcgttgatgtcagtgttctgcatttgctttagcttcttttgcctttctggtgtattgttccttgtttagtatggaagaatttttgaatgttgtacaacgcattgtccagatgttttgaatccatatgttttagtaacaatttttgccaaaatgaaaatcctacatgtgtattatagagggtttgctaacacaaaggtatgatttataagggctttgtacgctacttgggcctatttattaggggtaggactaggcctgtgggctgtttagctaactaatgggccggacttgctgtgccttcttgtcagccccacttcctcctccgccttttcttcttctagtcattgtaccgtgcctttgtcactaggtccggagacatcagatccatatgtcagtgacaaaagcactgatccagcggctgtgggagattgggagggccagcggtgtggctataggggggggggggggggggaaagatggggatgtatatcacgcggcgatcgccgagttcgtggcagcggtggcgctgctgtttctgtaggagacggtggccacggtgatcggatcgggcacaagagccaggacgctagcatcgatggcgaggaatgcgacggcatcagcctcctcgcgtcgcctgggccttcacctcggtagcatcatccgagaccaccacccgacatcagcagcaacactcgcttcactccctgcgtctccagccgcatccgcatgatattgtaaccgaaacaagagagtatctccttttttccaataagagttagataaatattaagatttatgtggtacgcttttcaaattattaaacggtacgtttcgtccgaaaactttttatataaaagttgctctaaaatatcatattaatatattttttaaatttataataattaaaactcaatcaatcatacgttaatatcacctcatttttttaatcttcatcttcatgaaaaaaaaaaacaccacgtaagagaccacacaacaccaccaaccaggccgcctcttcccgcccgggaacggcgccgcggaccgggagacgaggaggggcatcggcggcgtcgccggcccatgcttcgacgtcgtgatggattacgtcgacggacgggccgagccttgcgcgtgtcgtgtgggaggagctggcgcggggaggccgttcccggaggccaagactgatgtggcaactcctcgatggcgatgcacgtggcgggggtcatcatctttgatccggtctgcaacttctatatctacccattaactatttaatgacattgtaatacaacgctgaaattccatcaccgttttcattcccgtaataatccacatcaagaaaaaacaatccgcaatacgtataatttttttttaaaaaaaactgagagtaatacccgcagacatgctgaaacagtgaaacctgctaccactttattttctgtagaaaattacaagaacgtgttgcctccttttgacatattcgttcgatattcttttattctttccctctctgtgtacagaattacatgtgacaactgccttctgctttgcgtttcccacacctacggaagaatgggtgcccatcttgaattttatatacatgtcgcgccttgttaaaatgaacaattcgtatacacgaaccgaaaaccacaacacaacggccactgccattttgcactttcatcattccaaaatgtgcagcccccatttcgctagttctctacttccttgtaccctttatcatgggggcgggcctgaggagcaagtgcaatgcctagaatgtttggactcacaggggaaactctttctgaagaacgtcaaggttgcgtgaatcacatgcagcgatcatgtcagctcgtgaagcgttactggtttttaaaagagaaaaatgttagtcaattaaatcagcgttgaatttaggtagacaaagaaatgatttaacgtgcttggaaagttctagatgtactcaaattggaatatcaactggttgcaatgtttcttgagtacttgcaagttatgagtacttaaaagtgagcgacaattgatgttcttttgaaataaatgtatctctagtatcctccaaggaacttcaaatatctcatagataattaacaagacatacctaagagaaatccgcaagtactgccaggcattgtcagcttttggattcatagcaaccgcccgtacatagtatcgaatagagtcttcatacaatccctgcataacacggaaagctggggtattacatctctgttgccactttgaataaaagatatttgagctaggccgtggcatcattggatatataatatatatttgtactcatcctttattatgctctgtaaatcaacagttaacattaatattaccgaggctttgaatggatggtagtatttaggtggatatccaatgcacaaaaacttgaagatcttttcagaatcgagtggaaaccatgatagccaacatcttattatgaaaagcaaacaagtggaagcatacaagctcactcataaaaatgatggtttgcaagttagttgagtaaatgaataatgctgacagacaatgataaacaacattgagatatggttttgtacttgcatgcaaggaaattgttgaaactgcaattattttgttaaaaatacaattaccgaactaatggtgttatcaagtggtagcatcatgttagagaagaattacctggttggcatagctaatccccatattagcccatgcacgcacataattgggctttaagtccagagcctgaaaccagcagcaattgattatattagttccagatttacataccataaagtgctaggatacttgtattacacaattttctctaaattggagattcatcaacaagttctacacttgcaggactgcagtagaccaagccgtaaaaggatagttgtaccagcaaaataagtgaaggttcctccctaatggtattacaacactaatgctaggtgaagatgtgtctgtactcagcaggattggacaccaaaccaatggtattacaacactaatgctacctaagcaaacagtttgattagaattgattggttttactgtaatgctagaagtacagggatgcggcacatagcttgaactgaatgcactcttactatgaattatactgaaattgggtacccatagaggaatggacagaccgccagagggtaaaggtcatattttttttccaaataaaaatccaaaaggtccagatacacatcatatatggattattgccagccacgaattatatcctgttagatttgcagttcacacacaagtgaatgcaactgccataaacatcgtccgaaaggaataaccagagcccaatgaaagagtggatgaagtagctattctacacagcatgatcgagacaaagcactgtacttcttcaaccagactagt

SEQ ID NO: 69613 - DNA, 745 bp, Oryza sativa
ccataatttcatgacagacaatagtatgggttcgtccgttcaaattccatatatatcagtttatgaagttcttgcaagggtatgcaaaaacttgatagagcataattcacgtaatttctattgagatccagcacactgcatgctcctaccgaaaaaagattcataaaaaaaatattctaataaaacatgtgatgaaaacaagtgatgcacacaagcatgcagtgcacctgtgctgaaaaactaataatgaaaagttgaaaataatcagcacatggtaatttacatctacatatatcctcagtgggagagacacaatcacctgttggtcatcatcattttcagcatgtgttactccaagtagtctccaaccttcagcattatcaggattcttcaaaacttcagcctctaaagcaagaacagcttcacttaggaggcctttgcggaacagttcctggccttcctgcattggattagggtgaccaacgtatgggttcatgtctgaaaaaacataaactcctcgagatgcaccagaattctgtttggaagctgataattggttctggaacctaaaaggcacaaacagagcatgtgtaagtgtaactgatgaagaaaaaaaaaaggcttctgtcaaatagaacatggtacatgattgataaaaagggaactttatggttgcctataattaacccaaaaagacaagatattggatcaaagaagatttgatattcttatgggctgcaggaat

SEQ ID NO: 69614 - DNA, 3752 bp, Oryza sativa
gctgatgatgatgatgatgcaaggcttgtggcaacttgtttggtgaaagaacaacgagagggatactgggatagggatcaaaggcaaaggtttttgtttttaccccgtggtaattgttcgttcggtttgtgatgggatagttgctgggactgtgaatcattttgccccttcttatcatacagacaggcgcgtgatttgaccagcttgtcgtctctgctctgcctctatccatccatccattcatacatccaaccttgggggttcttgattctttttctcatttcttggggaggcttaattgttgctatcgccctccgcttcaggtgtccatttgaattcttcgtcgtttctttcgtatttaattgccatttgctgatttgcctctttatttcggtgggttttatggtaataaaggtgtggttcctttatcatcaaatttgaggtgttctgggttttctttggttcttttttggagcactggatttgtgtgctcttgtaaatcaaatagagtttgtggtttggttcgtattttacacaatcgagttgtgtttttattttagtttgtatcgaaatatttgcatacttgtttctagttccttcaggcttcagttctcttcattattataaaaaaaaatttggtcctttcgtccataatttttttcacaattccatttttgaatgtatgagcttgaattatgtgacttttcagtttgagcttgggattgtcaccttttcatggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgtaagtgacttcctcacctcaatcagtatttgctctgtgtaatgttcagttactctactcatgtggtttatatggaggatatatttgtcagtaaatggtgaaatctaaaccaagatacctattataaaaaatattctaacgcaagatacagcatctttaatttctcttatgtctctgcagcttcgtataattagtggaattttggagaagaaagtgactatatatgttgatgactgattaatcttaatgtcatggttttgatttatgcaggcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaaggtagttttctcaaacaatgttgttctattccctatttactgcaaatctgtaatcactgctcgcctgctcggcgcagtttgttttactgttccagcaaatctgacgagcaaaatcaaattatcagtgttttttatgcattggtctgatgatatttatacttttcagggtttcagtgttaatcatcaaaaccagccttcagtgacggataatcaccaggagctcagtcttcagtctagctcaactgcagccaaggatttcacttcagcaactattgttaaacctaagacatctgattccatgttagacaatgatgatcacccttcccctgcaaatgatcaagaagagaatgcaacaaacaaaaatgaagagtattcttcagacctgatcattacccctgctgaggatggatataactggaggaaatatggacagaagcaagttaagaacagtgagcatcccagaagctactacaaatgcactttcacgaattgcgctgtcaagaaggtggagcgttctcaagatggccaaataacagagatagtctacaaaggttctcacaatcaccctttgccgccttccaaccgccgaccaaatgttcctttctcacacttcaatgatctgagagatgatcactctgagaaatttggttccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaaggttggctagccttagtcactaatcactcaatgaaccaatcttcactttgagtagctgattgttttccttcaattttattcatttcagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggtcaattctaatgccatttttctcttttggaacaaattctttgcagttcctctaatccttcactacaaaagtaaatgtttagcttcacaatatgacactgtcatcgaaggaacatttctctgtccatatgtgtgcatccatagttggtacaaagaccggaaattactcgcattatctaaaaaactccattttgtatttgcaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcagtttggctatggctcagctggtcacagaccagcagagcagtttggtgcagcagcagctggtttctcctttggaatgctgcctcgtagcattgcaactccggcgccgtctccggcgatcgccgtgccggcgatgcaggggtacccagggcttgtgctgccgagaggtgagatgaaggtgaacttgctgccacagtctgggaatgctggtgcagcagctagccagcagctgatgggcaggttgccaaagcagcatcctcagatgtaaaaatggcaggaacatgagacaaatggtgtttgctgcttatgtatatgaaacatttttggtgcttttgttaggagaatggagtgttattgtagctcaatttactttcgggggaaaaaaaagcagatagttcaggcaattgtaggtagtagaggttctagaaaagataaatggctttggctgagttctaaataacttcctcttttttcattagcatgtttactggattgctaaactatatattttctgtaaaaaagattatatagtattt

SEQ ID NO: 69615 - DNA, 13263 bp, Oryza sativa
  unsure (1)..(13263): unsure at all n locations
caaattcaatcttgaattctgggagcaaaaaactgcagcaaaaaaaaaggtattttataactttacaggagtaactggtccgcagatttgcattatccagtaattgacgtgcagcagaagatcggacagaaacaataaacagtcaccatttgcaatgcttttttgcgggacagaccaaagtgtacccagtatactgtcatgtcagaacttcgaaacagtcaacgctaacaaaagcgaatcacaccatcaccgcttatatattttctctgcacaaaaatgtgcatatgtggcaactccaagaaactttacatttgacgaggatattttttgagtgaggaggttttaagttaaccctaatcatgttgaaatgtcactttataaatttggtatttctcttcactaaaacgtacaaccaaaacttcagcacttctttttgctcagtggccattaacagctgactgctggaaattctctctttgataaatggctttccaccgctcaagctcttccctgcgaaataatataaacaccagaagttagaaatgggaggagaaattgacccctttctttgggaggagggccagttgcagacaattgcttatactgttgtacaatatcaggttctctaatgcactgttatatagtcgactgcgttagtgctatattatcttatgatgtatgatacaaaagataattgccaatcttgtaggatacaattgtttagctgattattgtgtttctaatgaagcaattaatatatgatcacttatacaaggctactttgtttaagtaattatttttgtagaccactgtctacacctgaacagaatgtacagatgggacaagtgcactgacattgagtatgggagccaaaggagacaaaaaagatcaattaatctgcttgggcatgtttttagattgtttagatctgggaaatatgtgcatagatacagatcattgtttatgtctaagctctactgaaattagctagtcccgatcacttatttgagtttgaccttaaggaacttgatcccaacacagttattaaagaaatcattaagtatcggaaagaacaaaagttgtgtatatatagtccacatcgtataatggataagctaagtcttgtgtaccgaggtggtaaattcaagtgccattgggcagttggggccaattgagttatctagtttccccaaggcaattagctgttccaattattggttcacatccaaaaagaagcagccactgcaattcaataaatgaaagaaaaaaatacaagaaggattaccttaagcaccaccctattgaatcataatgaagaaggccaaggaccttacgtcttccatcattcctacggccagccctccgttttaccactggaagttgcttgatacctttcacttccatgagcaccttagcagtgctcagatctgtatctggaaagcaggtcactagtcctctttcattgccgtggtactgaaaccctctagtgaggcatgatgaaacaagagaagaatttgcctgaaacaattaaagcatgtaagtatgtgcatcgctaatttcgatattactataagggcctgtttggataggggtgttcaaatttaaatactttggttataagtttaactgcacgtctgcatcctataaaattccagatccaaagcatcccttaaaacggcaattgctaaattaaattataggctttaaaggtgtgagattttgcatacatccaaagtagatgaatttgccccattccgtggagtatcttcacttaattcagattcaaatcctttacggcgaatgtcaccaatcgtaacaattccttcaagaaaatcttcactgtctactacaagaacacaattttgctgcttatcatgcataagccttgttgcctccttgatagtcactgtaggtgtaaccttaataaattgctttgacattgcttgtgatacctggaacactcgttgttagaaagctgaatgaccacaaaaatatatcaaatttactaaggatgaacttgacaaaataataaagagaatgtagaaaagaggcatggaacctttaaatcatcaagaagcatatcctcattgttaataccatagcggtagggatcatcgtctagaattgcaagttcaacgtcatctctgtctggtcgtctccggtctgtctcattcctatctgtaggaggtaatagtgaagaataaccatgccgaggagatgtagcctcaaacgcctctttgttgccagacattacaacagatggcacccatattgctaaaccaacagctccctgtaaattaaaaataagggtgagcttatgtcacaaggagtgtgcaaactttcatgcttagaagcaaaatagcaaatatatgggatgagacatcaccatcagaggcagtaaaattctgtaatcttttgttagttcgaatagtagtagtactgaagtcaatggaactgagcagactgatgctagtgtggcagccattcccacctgaattaagcagacagtcagtatacttcgtttctatcaaactttaggctaccttcctagctcaaaaaaggaaacttactagtgcataagcttgagggtgtgcaacagcagtgttacccgggatggcagagtttattagttctgctgctgagcctccaaatacagcaccaacagcagcaccaatcatcaagcttggagcataaaggccaccaacaagaccagaacccttgcagagtgcagttgctacaacttttgcagcagccaactgagctaagagccagattccaggggctgaggcactttttccagtatgtaaaatttcatcaacattggtgaagccccagtacagtattccagggtaccttagagctattaaacctgctccaagaccccctaacgcagggcatactacagcagggaggctgaatttcttccttatcaagtcaaaagtctttgtgaaccaaaccaccaactgtctgaatgccacactcactaccccacaaagcatgcctaggataaggtagagtggtaactctgcagaatataacattagtgatttagttggttgcatatttaccagttagacatatcaacatgaaaacagtaatagatacacagttcggcgttcacgtcacagatataccagaacttcaaactattcaattgtgaatggcaagaaaacaagatcggaacaataagaagctgctaaaactaacgtgttgatggtaagggaaccaaccacaaaacttcaaaaccatgagcatatacaagtgtataaatgcgtgatgcatatataaaatagattataaaggcaggatatcacgagtcctctgctatagtagtaagaacaaaaaaaaatctactcaagttcaatacctaactaagcaaaatccaccttcagtaataccaggtttgatcagaataagataaaataccagcagcagattttagttcatacgtcgggacaataaaagctgccttctcccctagcaaaacattggacacagttgatgatataactgatgccaatataatcatagcagtggtaaatggcggtgaattctctgctcgaagtggcctcagtactgtttcaatagcaaaaaaacatccagcaaccgcagcattaaaacctaaagacaaagcaacacaagtgtcaggagagaataaagaaaaaagcattggcctgaagatactggatgttaaagagatgaaattgcaaagatacgtggtacaacaaagatctatagtattgtatttgtagttccagttgcttgcagaattagtttatcttccttttcttgttaacttgtactaacatcttataatgctaaaaggcagtgggaaacgattccaatctgttgcaattcccagatgaatgtaaaaaaatcaaacagatgatgattatttaaaattacctgaagcaatcccagcagctgatccggcagcaacaagagcaattctccgttccctattgttctccatcatttcagcacatccatatgcacaagatttaccaatatcaacgcttggcccttctggccccaatgaacatcccgtccctagagtaattgcagcttgtattgctttgattgtaggaaaaatcgcagccatgaaatcaacaccttccctttgagatgataatgattgttttatctgctcaaatatctccagtaatccgtgcatcataccaacaacaactccaccagtcactggaattaacaatatcctatgccatgtatcagcaagtctctggaggcgaagccaagcagctccctctgtgggtgtgcctgcccatgcccattcatgtatgatatgcacctgaaaagaatagttagccactattgaaccagcagattggtatatgagaaaagtacaaacaggaaacttttggtttagaaatgatcatctaaacttgattggatagctcccgcttaacagatctaagttatttcaaggaaagagccttttctagtaactttaagaaatgggggttcgattaattgcagttcagtcaaagtaaaataggcacatactgtattaacccggtaggacttttctgagtttctatctgatcaattcagatctatgaagtattcagagaacacaaacaatgcaccaaaattgccagcaagtagacataatctagtaaacctcagcagattataataccacgcaagattcgttttcacctaaacccatgccataagaggaagactttaactagcaaagacctcatgtttgtatcaactatccccgtggcatcaaatttcacatgaagaaaatacattatcatctccacgaaacaccctaaacggcaggataaagtaaatgtacagtccatattctcacacgagaaaatggacatttagccacgttcaaaacatggcttcgctagaatgccatcccgaaaacgcgtttcgctaaaatgccaatatgaaacgcgtgctcactgccactttgccattttagcccttttgtgcattttcgaaatcatttttgctcctccaccgggcgatgagacaaaattgcccttcatgtcctccgtcgccgctgttgaggaagaggagctcgtcctcgctggccaatctccatgtccaccacaagcagctcaccgtcttcctcccagacggcgaggtggccggcgagtcttccgacatcttcctctccctcgacctcgccacctccgccgactacctcgccgcggtcgacgacggtctccgacgaggtcgcttcactgcggttgacgacggcggctagggtttcgaggcggccccatgttctcgccggtgacggaggcgaaggggcggcccatggccttgccagtgactaaggcgaagggggatgcggtggataagcaacaccngcttctttgagcctcgccggcaacagaggcggatggggcccagtggaaaggcactacagctgctggccagcctcgccggcgatggaggcggagggggacgcggtggagaggcagcagcagttgctggtgagatggagcgcaagcctccgccgccgcgaggcctccttgacgacctcgcctccgcctccgcctccgccttgttggtgctgtccggcggcggcggccaggggcagccgccggtggttccatcactccgcgcacccgcacacccaaatgccctcgtcggcagtggcggtgggctcatccagcggcgttgccggccatcccgccctcgtcgacggcggctacggaaggggaaggatggtggatggaagggcattttcgtctcattacccactgaagaagcgaaaatgatttcgaaaatacacaaaagggccaaaatggcaaagtggcggtgagcacacgctttatattggtattttagcgaaacacgttttcaagattgcattctagcgaaaccctgttttgaacgtggctaaatgtccattttctcattctcacacaaatcagacaagaaattcctccaaaacaaagtgtacctacatattgaagggtgctatatacagcattgcgtttattcattgcaacctaaactgtccagtagaaatcccctgctcatatatcccatcccaagcaatcaccttaaagatatagatctcgcaagaataccagacttttcctagtctaaggtaattaacgttttttttttcccgcaactttccccacgcagatctctcacttaccccgcggttgaacgcagcgacgcagatgccggtggcgaggccgaggaggcagccgacgagcagcagcgcccactcgggcggcgcgccgtccccgagctcgtcgctgtcctcggacccgggctccccgccgccgccgcccctgggggacgccgccgcgccctccgctgcgtggcggtggtgccgcccccggctggacagccggcggtccaggctccgcagcagctcgcgcacgcggctcctcctcggcgtcgacggcgagtccgggtccgccgacgacggcagcgcccccgcccccgaccgcagcggctccaggtcgctcgcctgcgccatcatgccccgccgcgtgcgagcgagggggatctagaaccgaggcgatcgcatcggagtaggggaaggggaggatctcgcggcggatctcgccggtggcctcgatctcgtcggcggttgggggtggcgatggcgagaggtgaggtaggagaaggggaaggcacgttcgcgcgtggcggtttttgcagattagccctcgagagagtttgtagttgcaattggtgggtgggaggtttggttgggccgggttgcacttgggcctagtggacacctgccaggtccattcactatggttggcttaggttggcataaaaccacttgaacatgttctttttttttcaaaccattaatcacttgaagtttgatattcacctcacaagctattttgtcgcaaatacccactaccctacttagttttttttttcaaaactcaccctagtatgcacatgcttaaatccaatcaacatttcgtaaattgtgagttatcaatgtggtcgctaccaaattaaatacttctacaagtatagtctcgatgtatttttggagattccacgagtagaattgccaatgaaaatttaaatgtcgcactgagtttctctatataaaaagaaaatcaatgaaacatgaaaagtaagtctaatacaagtacttggataagatgactaaggtagtttagcctatgggtggctctacattagtgaaaataagatgaggttaagcatgtgccaatggggtggtctttgcaataaaactaaataggggtgggcatttgcaacaaacttacctatgtggtggaatgtaaaacttcagacaacttatgggtgttttttttatggctttggaaattggattgcagagggaaaatatcgatattgtgcttggattagcttcctataaaatttttttaaatgaaatttagtttttacgaataattttgtgcttgtttacttaccttcttagcaatcatgaaaataaacctatgcactaaagtggcgaagaaatcataaaatcgaatttcaaattttaaatcaacgatggtatttgtttcctgtgtcatgacgaaacagtttggatgttttgcaatattttctgttttacctgtcccacattattgcttggagtatttgcttagcacgtcataatttcagtggagaatccacataaacattggtggtcattgttgcgataaaaaggcgtaatatttcactatttcagcatgtcgtcctgtcactattcactagacgcattaagctagaaaggagctttttttttctttctgtggttgcaaaccaagcgtgaagcaaaaactgaagtattttgaccaagaaaaagatgtttcactgctttcagtgatcagtcaaagcattgctttcccaggaaaaaggatgaattgttcggtgaaatgtcactgaaaaagatccctggggtgctcatcagacgttaccatttttcctgacaatcttgcctcaaaagatgaatcaggaagcaaggttgttcatttgatgtaattgtagccatacatacaaggaaaatctactcaaacatggaatttatggacttatatttcaggcccagattagaccatgaatgcaggattatgtacatatctttcatccaacagatgagattagtcttcactcacctggacaggttactggacactgttctatgctgaatcttgaaagcttgaaaatattagtatatactgctgcatcaagcgtatgactgataataagtatactcatatggagaatcctgacaaacaaaaaacatttaccaatcatgcagattagattagtcaataggtgcaggttctcagaaagcatgaacagcttgagaacatcttctgcttatcagctagagacaatgcttcgtctaaatgaactgattcagtgaacattcttcaccaaagttactatcttgatgaaataaagccatttccctttctgaaagttgaatccagaaaactcaacagtaaagagattaaaagttttatgaaatagtaactgaactgtactgtacatagcgactcaagttacattcatatggcaccgtgaagcttttggctatcatatgaccatcactaacaaaacttgttggcgtcacagattcagaaatgccgagacatgaaaacttctgatcaccctctataagacagtaacaaaggaatacacatcagtacattgcagcaactcacaagggtttcagatatgatctcaaatcttactcctgtatctgaccagctttgccaatgtctcttgagcagccagtgtatgggcatgaccatggccaagcataacagtccggatgctaatgcaagtcctgcacaattcttcgccggtgtcaaacagcccacctcggagcaacagcttcgccctcgtctcgagcagtgtcgctttgagcagcgtcacttcctgccagacaaactcatcgacacggtgattcggttgcagcttcttcctccagcaaagcgacccacggttcaggtcctggatccgcgatgcgtaagacttctccacctcctcaaggacattggtgcacaccttgagcagttctaaagccgagccgcaccgtgagaatgtcatgaaggagtcaattgccaagggaagtgccgtcttccttatgaaatgcaccatgtcgactgccttgagctgaacagaaggtggttcagacttgaaaccaaacacaaggaatgcactagcccataagtggtccgagtacactgaggggttaccagccctcattacgccgttcactgctgcagttgttggtgccaaacctcccctaatcttgccaaagagctgtgttattgggtggaactggatccagcagccaggatgacgagttgcctttcttgccagcccaagcttgacaagtaagagtgctgactccacctcagcttttcgaccatgtggagctagaaagcaatgtgtgccgcatagaaatgcagtcttcagggattcacccaacaggtgcatactgcctttcattggtagcttgctcgctgttgcagctaatagcgtagacgacacaggagcaggagctaaccaagaaccagcgataatcatctttgaggtaaggcttcctccttttgctcggtccatcaatgcaaaacaaaagaccaggacctttattaggaaagaattgttacgacagaagccatcgtcattggcaccaagtgggaacaaactctcattcagtgatattctctcgacagcctcaaacagagtggaaggtgtaatcatgagctcagacagcagtgaaccaacgatccacaggccaaagctcaaccgacctaaccgctcgtcaagcttcctaagaacttccatttcctcaggcggatagtcattcttctgcttcccctttatcaatatcatggcatcattgtatgagagctgtggcagttgcatcggttcaaggttaatcacacgtggtaaacgtgtggtcacaatgacatgtgtcgctccagtgttcctagggatgaagtcatggagatccttaccttcccaccaatccctctcactctcaaggttatcaatgacaagcaagtacggcacgtcgcggaacagctcccgcttcaccctctgaaaagcatcaaactcctgctcctcaaagctcctgatcctacctctctccttctcagcctctgcactgatgtccaatcccaaattcatggataaattgagtatgttttgcctcaaataccgagcttcacctccaatccacaggaccatcttgtaccgctgtgaataccggtaagcaaattccaatgccagttcagtcttgccaattcctgaagaaccagtgatgcagagcacactggcactgccatatcctttgctgttgcaccgaaaccttgacctcctgtgctttgatctctgcttctgaagatttctccctttacccgatgataactctataactggatcaatccaggcctccaatgtcggctccttgcacttgcgcatctccaaactgatatacctggcattcgatgtcctcactgtgtcactctcctcatcagcaaacccatcagacacaccactcgatctgtcattcgcagcggaacccctcgggcaatcaacctcttggatatccaccgtggaaccgaagaacattccttcaatttcacttagctccttctcccttccaacgaaatgccggttccgcggaaaaggcattccttcaggcccttcactctccttctcagcaatgctcttcctgccaagcttggaccgcagcaaggtgaccgtcttggacacgcagcttctccaattggtctcattcgcctcaagcttaaactcatggcaccgcatcaatccttcgaacgcttccttcccctccttatcctccaatttgccgtcgaaaagccccgcgatctccggtggctcggtgtcgaacagtatgggcaccaggttcttcttctgagcaaagaacctgatctcctcgaggctgaacggattgaggaaacttgacatggtgacgactatgacgccgaatgcgacggagcagatgatccggtcggcgatctcatggctctgcgtgtcggagtacttggcccggtcggcgacgaaggaggcgatgccctgcagctcgagctccgacttgagccacttgcagaaccggccgaggctgccattgccgtggtagccgatgtacacgtcgcagctccggagcttggcgttcgacgacggcgacgccacggagccgcgggtgaaggacacccgcggcacggggaacgagaacgacacgcgcggctgcacgccgccgccgcagtcggagaccttggtggccgggtcgatgccgccggagtcgtagcgctcggacggcggcgtccgcgacgcgctcggcgcatcggtgtcctccgagttggagtaggacgccggcggcgacggcgccgccgcttcctgcggtggcggcggcgccgcagcgggagtcgggggctcgaggactcgaggcgagatgtacggcgactgcagcgccgacacgaacgcggaggacggcggcgacggcgagtagaggtgcggggtgatggagatggccggcgagatggggtttgaccggtcggagctgctgctgaatccgccattggtgcggatggtgagcgacttggtggcggcaatggggatatccttgggcacatcaagaaagctcccagcctccttctcttcctccatggctaccaccaaatcacaaaccttggcaagcaatctccaatgcactgcatgatcttgtgctcctcatgttcctatcaaaagatttgggggagaaagggaaacaaaacaacagatttttgtcacaaaatcgatgaaagagagcaaatggagacatggagtaatcacatctgattaaaaaaaaacaaagaacacaaagaactgttctaataacctgcagattctctgattgattctcaacttgattccatttgcatccaaaaaaatgtgtaaagaaagaagtttcaagagagaaaaaaaaacttactggtaaggtatccttcaggaatccaatgccacagaaaaaccactgataatatcaattgttttctgcagaaatgcagaaccacttgctgatgaggggctttagcttcaagaaccaagaaaaaaaatggcaaggagagactggagccggatttggaatttaaaaaagaggccagcttttcccactcaagccattgaatgggacgggtataactataactatcccacctcctgtgatctttgtcctaggaggaggaaatgaagggtggaggccccttcatgacaagcaaagtacaggttcagtttaagggccctcttcctcccttcatatgaccaccacaaaccctaaaaataaataaatgtgtgagtgtggcatcaaaaggagcaagtgaatgtggagctactactagtgctagtgctagtggcacacaactgcaaggtgaagtgatgaagaagaccagcaccatttccaatggtgagatgcaagccaaggccaaaaaccaacccaccaaaacagtacagctcaactgcagcagcaatgccaaagcaggtggaaaaaaataaactatataaaacacttttattaggaaaatttttatatatgtgttcttacctgtttaaaggttatagctgaaaaaataaactataatagaaaaccttaaaattaactctaaatgtaagtttaaaatttaaattttgatcgtggctgataagacaacgtgaagacaataagagtttttcttcatgtccatttgagtccaatattccgtttaagtctcatcttaagatgtacctcctttgtccaaaatgatttaaattctaaagataaatctagacaatttaaatctttttggacgggagaagtatgcacattatactttgtgcacatcctgataggagtgttgttgcatgccactacaattgatgcatgctccctatattaggagtattcaccatgtaggagtagattcagcaaagcaaagggtgattcacatctgaaacagtgctttcaaagtgggggtttggtgataaaataggctagtaagaccttgttttatgtgcattggagggtgatgaccacacactgtgtaactattttacagtgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69616 - DNA, 1226 bp, Oryza sativa
  unsure (1)..(1226): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccatgttaggacctagacgtcgtcgtcgctcctcgatgatcctgccagttaagctaaaagcagactccgacgatatagtagaaacaggaacagtcaagacatctctagctaatatggacagaacaggatatgtgtgtttgtgctcatgccaccagtttaggatattgaagtcatcgtcgaattggttgacagtgtcactatcaagataggcagacaactcagaggcattcaagttagcattagaagaaacagcctgaatcaaagcagtagcagaagttctcctggaaaatggaccagcaccaagtccagaacctggactggcactagcaccaagtccagcaccaagtccagaacctggactggcaccagcaccatgtccaagtgcatcactggcaccaaaaatctttccccaggctatctttttcttaccagcagtacaacctggggttattctttgcaatctcacagcaccaaacttactttcatactaagagaaaatgtcagacaatgcagccctaacctcagttaaataagtagagtaatcagaggtcaaaatttgtgacataatttgtagaacattgctaaaacctctgatcttagccctaggatccaagataaaagcaaatgaatacagaaatggaatctcagaccagtatgccaagaacttacttttcatgggaacaacaacatttctaaagttattatcattctcataagtgttaagatgtccagcaatctcaagaatgtgatgcataattaatggagatgttggataataaacaccagacaaaataacagttgaatcataaaattgttcaaggaataaaagcacagtttcaacaattgtccagtgcaaatcagtaagcaatagtctaccattttccctaggataatgagtttcaataaacaatgaaaaaagctccttatgtgggaagagatgcttgagcattagataagttgcattccatctaacatccatgtccaaaccaaacttacgaggtcgaacacccttagcaatacaccagtttttgtataaagcaatgcgctgattagatgcattcacaaatgagatggctgttctaaaatcttgaagcatggg

SEQ ID NO: 69617 - DNA, 707 bp, Oryza sativa
atgaaaaagaaagaggaaatcgagagcacggccaacgatccaaagactggagaggcggagatgagacaaggtcacggatccggcgaggcagcgaccctcggtggtagatccggcaaggcgttcatcagagacggcgacggagagggatggagagatggaggcgtggtcgcgtggaggtggaggcgtggatcgacggaggcggaagcggaggcggagcggtcaaggcggaggcggaggcggaggcgtgcgtggatcggcggaggcggctagggttagggttagggttgtgagggaggcggactggcggaggcgagaggacgcggtggcctttatatatgaggcgtgggcacgcggcggcggctcccgatgggcctcgtcgggccgtgcctaccgttatacaggcctgggccgtgtcggcccatcgtgccgtgccggcccatcgtgccgtgccggcccagcgtgctgctgcgggagcctaggcatggcccggctgtcgggccaggccggcacgggcacgaacactgacgggccgggccgtgcttgggccgggcagtcgggctgcgggccatatggccatctataggtgtgcagtttgtaacagcgtgtagtgaggcgtgtttcatctacagggtactagtatctactggtgctgcttgatttttgtcaggcgtgtgcttacgtagctcagcaattttggaccgtgatgg

SEQ ID NO: 69618 - DNA, 2037 bp, Oryza sativa
ctttctttggatgttcaacacttgtaaaattgctgcataagcactttatattgttatgttagttcatttgtatctttttatgaatgctcatgtttttgtttgtctacacaatccttagcagcttccctttcaagtttcatgctaataaaagatgtgctctcagctcacttgtttagggacaaaaaggctgtgctaacgacaccgttcattagctgaaataatctttgtaaaatcaacccatcaatggaattgcagcataatttagctagtgggacatggagtcatttcagttcagtatagatgcagtttttgtttacttgtttgttgtcaatcattactgaacttgttggatgtgatctctgttgcacataattgcaaatgcaagttttattgaacacttactacataagttacacatgttatgaagtaatagaattgtgtatagctatattattctttagtaccttttccgtacaaagtgtaagataggtttttttctaatagcatgccattaatatagggtttatttcatggtatgactctttactgtgctgttacctctatactcctcatacaaggatacctaactttcttgtgcaacatggatttaggattaaatatagcccttagaaataataaattaataattatggggtttctggaaatttccgatgctctgttatcttggatggaatttgtaacttcatttgaaatagttggtggttaaagcagataatatggattgtatctaatctatcatgaacatgtacactgtgccagtattaaaaaatgcatctgcattccatttgtctagtcgcatgcacttgcatctaacgcttttgttttggtttctttcagcgatttttagttttgtgttggaaggcaatgccctgaaggctatagacctgacagaagagttggcacctaacttgctagagaatgatatggatttgcattttgatcttttaagtcttcacttcattgagttagttcgttctagaaaatggtaagtagctttatttttggaaaaaaaataactgtgccatgtattttggattaatctggatgttttgactgacagcacagaagctcttgagtttggtcagaaaaagttgacgccatttgggaaagtgcccaagtacgttgagaaactagaggtaacttttcctaaacctacatatgcttatattagacagttttcaggtcatgcaaattctgtcttcttgtcaggccatcaatttagagaactggcaatgatgttaaagaacttcactaccatttgttacccatacaaaagaggcaaaacaaaaatattggtcttgaaaaaactttcagtatggtgaatctagtttatcactatgcatgagatatagatttctattcaagtacttagctacttgcaaaacagtattggtacctggcacaccttcatttgccctatgttgccgccttgtagatctgatttgtcatcaaagttatgtcagcctgttttctgggctatcatgtattttgttatctttattaaatacatcagatttaaatggcagcgcggtttttgtattgcatttgtttagtaattgctggtgctatactgtcctatccaagtaccgatgctaggtagtccatcattatcaacgccggccattgggtattatatttattaaatgcaaaatatggtgaaaacgtttgaagtagaggtgccgcttaacaaaataaatatggaacatatggtgacatactttttgtgtattgaacttatgattggctgctttgtaatgctatgcttggaatactatgaaaagttaacttttgttttatatgtataggactttatggccctcctagcttatgaagagcctgagaagtcacctatgtttcatctactaagcccagagtacaggcagaatgttgcagatagcttgaatcgggctgttcttggtatgttctaagatattgttcttggtatgttctaagatactatttgctgtggtctcatccgctgatgacacgattgtgatctttgtctcatgatcaatg

SEQ ID NO: 69619 - DNA, 11443 bp, Oryza sativa
tgtttcctcatttacagttccccatttcccctttacccgttgacgccatcgaaagttgtacatatcagaaccttgagctattctgtatgttcgtgcagagatatcgtcagtttgaaccaatctgcagtgcacttattactatgcctgatgcttggtctctacaaactattggtgtgttttatggcgtccatttcaccatatcgactgttccattcacccaaagataaaaggaaagcagagcaagtgacaagaccatgggaggagaattctcaaaaatttcttagaatgtgcacttgatgctatgcctgatgcctgatgctggtttctacaaaatattgatgtttttcatgccgtccatttcacgacatcaactgatcgattcaacccaaaagatgaaggaaagcagacaagaaagtgacaatacaatgggaagagaattctcgaaatcctcatataatcagaaaaggaaaacacgggtgccaactttagttttccatcgtgaacgccgggaatcacgaaagatgagagcgagcggagggcaacaaaaaaaaaaaaaagcttctttccgtcccgtgaatcaaaccgggcaaatcgtagaagacctatacgcaaattgcagaagacctataggtaagcgaatccagttcttccccagtagtagctttcaagtttcttgagccgtttacgctgcagtggctgccagctgctctgtgaattttgacgatgcttgctcttttttttttctggccctcgttttaccggttccactataaataggcaggtgagtgcttcttgtcgtaatagtaagctcatcacttggcaccagctgtgaaaaaagcttaattagtcaattctctccgtcagttgattttgtttggccaacggaacatggtaatttctccctgtttgttcattaacttgtgtgtatttatctgcatgtatgaatgattgcgtgcgtgctggcaaaaagaaggaatggaaataaaaaagatggttctttgatgtagagttctctgggaaacgaacatttatatgggagtatgtttagtgtcttcatgaaacttgttcgtagtttgtcctgctagtttattatatctttgaagtaaactttcagtttccaggttacactttcagaatttcagtagcttgcttggttataagatcaaaatgacatactgacatcaaatatctatcctgcaaaaggtagaaactgaaccaagcttagcttttgttggtcggtagaattttgttaggaccaagaggcttaactcatagatatgcaaggataacagaaatcctgttagtcaagaagagtaatactaccaattatattgatttaagtgctaatagatggtggattacttcatgatgtatcatgaacctaacacaaatataatgatctgttcatgtccaatagagctttaaaggattcaacgggaagaacccgatactcgttgggccgtggggagggttgggaggaaccctttgggacgacggcgtgcactccacggtgaggcaggtcgtgattactcatggtgcagccattgattccatcaagatcgagtatgacctgaaaggaaagtcagtctggtcagagaagcatggaggtgatggaggcaccaaaactgatcaggtttgtctgaattttgtccccaagtccctgacctgagaatttaagtactcagatgtgccaatgtcatcacaattttattccatctgcacaagtatgctacttaaaacttaaaagtaacattcttgaacggacatgtcatagttgtgctaatttgctaaatagattaagctagaaattcattgctgcaactgttttctgcaaacagaagacatgaacgtcttgctactttttctgaagaaatcacatactctgacaagaacgttaggctgcaggcgtttgagtttcagactgaggaagtggtgctgtttctaacaggtgaaactcgactaccctcaagaaatcctcacctctgtcagtggctactacggatcattgggaggctgcatcgtcgtaagatcactaacattcaggagcaacctctccaagtacgggcctttcggctccgaggaagggacgcccttctcgctcccagtggcggtcaccggtaaggtcatcggcttccatggcaaatccgggtggtttctcgactcaatcggctgccatttcaagaaggagaagaacgccactccgtcgtccaatgctccttcagctctcaggagcatcacgagacctcatgacaagaatggcaacaggtacgcagatagcaatgctgggtatgacatggttcttgccgtcagagacagaggtgacagctacagtgtcctgactagcaacaatcccaaggaacagtatcctaaccaatcacaggatgctactctctggaacaaggtaggataaattcagaaactctacagtgattacttggttcagagtcctttacatatattgtagctgaaaggggatttattagtacgtggaattttgctgtaatgtacagatggtgtcactgcctagtttctactcggataatgggaccatgacaataagcactccggtgagatttggtccctggggtggaaatggcggcaccatattcgacgacggtatatacactggtgttcgacagatcaatttaaagcgaggattgggtatatcgacgatgaaggtcctctatgatcgaaatgggcaggctatatggggtgataagcgtggatccagtggggcagcaagggctgagaaggtgatgcaatttctgaatttcagcttctgaaaaattactctgaaactgcacttcagcttctgaattttcagtttcaaacttgtgatgtactgctactagtactagtcctgatggtatggagattttgtttgacaggtagtattcgattttccatcagagatcttaactcacataactggttacttcagttcgacgatgatcatgggatcaacggtgatcaagtctctgacattccacacgacgaagaagagccatggtcctttcggggatgagactggcacgttcttctccagctgcctgaccgaaggtaggatagtaggattccatggcagggatgggtggtacatcgacagcattggagtccatgtccttgaaggcaaggtgttgtcacagagagctgacagagcattgaccgaaacgagcccgtctcggcacgccgatatgcttgcagtagcacagagggaaataggagatgaggtaagtgtaccatgtcccaaatgctaaattgcaagaagtattagtagattttcagaacatctttttctgtgttgctgatagtgaaactattatgaccaatgaaaaaaagtgttttctttttttttgtgagtgtgtaggttacatatggtgtggtgaaagaaccaataccagtagggccagggccttggggtggcgagggaggcaagccatgggacgatggtgtctacacaggagtgaagcaaatctacatcatgagagccgatttcatcggttctgtgcagattgagtacgacaggagtggccaatccatctggtccacaaggcacggcaacggtggccagataacacacagagtgagtttgattactcaacttgctcacctattttcagtaacaaaattcaagctgtttcataatgatccgagacaatgtggcaaagcagatgaaattgtctgcactgcaagcatcaaccagtctcatgtaaccaaagcttaaagacttcagatgagatttgtatgatgctaattaatcaactgttcaccaaaatgccggtgcagatcaagctggactacccacacgaggtcctgaactgcatatacggctactacaacacctgccaggatgaagggcccagagtgctgaggtcgatcactctcgtcagcaaccgggggaagtacgggccgttcggcgaggaggtcgggacctacttcagctcggcgacgacggaagggaaggtggtcgggttccatggccggagcggcctgtacctggacgccattggcgtgcacatgcagcactggctgggtgacaggaacagaactgcagctcccagctctaataagtactacatctccaagtacctgttttgattgagctctgcagaattgtgttcttaactttgtgtttgaagcatatgcttttgatgtgaagtccaaagtccaaacactttcagatttgaagagtggcgtgtgatttattgtgtgaacttaaaattattatccgtgtgcatttcctagattcagaggcctggaatgatttgatcatcttccatatgaaacaaaaaacatcagaatgtatgtgatttatttgtccggtttggagatttgattctctccagcaatggagttgtttttttttctttcagagaagtgataggcctaccgatcagactaaactttctgtcgtgtcaaagatcaccaaaagaggtagtgatctgatcacgatttcgttgtcatgtttcgggttcagtcgtcttacgtttgcccagctggtttccgaggtggagtcgctatgggatgaggacatcctggcgttattctttctttcactggtgacatcaaaggcggcaatgcatgcatgaagcatgacgtttgatgtgctttcaggattaaaattgctgcatttgtgcttgctgctggtaaacactaaacatgccatgttcttgagcccaacctggtggagagagcaatgcagagggagtagagtatcaatgctaatttggactctagctgtgtgacacaggtttgcagagagattcagagaaccggatgatggtgaagtgggtgaggaacagggcaagtggcatgttcactagtagcaaccaaaggacaattcgagcctagtggacactctatactagtagtactgccacgcaaattgctggactgaaattctgtcaagtctgaaaggattggatgaaccttgccaaaatatggtagtacacagcaggatttacttatattccaccatagatcagacactacgcacgaacgatcgtgtgtgtgccggtgtgtttaactaatgaaatgacggtgatttagccggtgccatgatttgtcctgatgaaaaacctcgctggctagctcagctagctgcgacgaacatccatggagagagataagattctgtgattctgtccgtccaaatcgccgccctcttttttttctggccaaagtaggaagaattcagagcagcaaaaggaattgcagtttcgcagggccacacgaacctgtcggatgcattcgctctggacagttttgaactcccctctggacgtggtcatcttaggagaggaagcaaaggaatcgtagggctgagaaaagaacccgtccatgttcatcctccaggcaatgcatgctttcccgccgtcataaacaatgtgctgtaattttcagagtcctcagggtttcagatccttattatttgtccacgagacttagagaaatgatacagtggcgcatttgataattggtaatattatgtgatagggaggctcacggtcatggagaatctcaccgacccggatggatcgatggatggatggatgcagcggtggaaggcaaagtcaatcccctagctgggagtttggtcggcaaatctgaagaccggtgatggagtagagtagccatccagccactagtggcgcatttcgtctagaactagtagtattacgccaagttttctttttttgagaacttattacgccaagttggaatagaattacagggatttcttcctctacctcgcctatcttacaacaggtacaatagcagactataaaccagctataaacacatttcgagaagattagagaggatagaaaagagcagcaggatatagatttgtagatagctgcaacacaaactccaacatgcatttgtatattacaggtgggacaaaatattaattgtgtagtattccctccgtcctataaaaaacagagtctagaatcggatataacatgttactacgaatctagacatatgtatgtctagatttgtagtattatgatatgtaacatccggtattatattggttttttataggacggagggagtatatgtttatagatagctattgaatgaattaactactaaattgactatatgactatagatgatttaaggccggttcttctaattagcttggcgccaacaactatccgatcgagcactgaaatttcgcatgtcgcgtcgggcgggggggagctgccactgccaccttaaagcgagccgcttctggaacgagatctccgctgttgcgaaaatcttccttgggactcgcgaaagacggggctcgaatgactcgtggccactggattttaaactacgcgcgagcctacttgcctattgccgggaaggccacacttttgggccttttttctcatgctgcgtccatgacaatagcatggcatgttggggggatttgttcattctctctcccggttcaggatgagcccccggtatcgatcggataatttttttagcatgtgttttttaaccatccaagcagaaactccaagttgttgctacttttgaaataaaaaacaattgagaaaacctcaaagaaaaaagagcaaagtggtagctacactaaattgcaagtttgtccagcggatataatatatttaacagccactactcctctcggtgaccttatttccacctgaattatatgcgatggaatcatggaataataactttgtaagcagtagtagcagtcaggtatccctaaattgcaaaattgtccagcggataatatattcaacagccactacttctctcggtgacctgattttcacatgtattatatgcattacttttacatggaataataactttgtgaagagtagtacttgtcaattaatgcctccatctctcaacagataacaccattgacttttggcacaacgtttgatcactcgttttattcaaaaaaatgtaaatactaaaaaagtacaagtaatgtttaatttttttaataaaaaacaagtcacaacaaaataaataatacatgtattttaatttttgatatgatgaataaccaaacgtcataccaaaaatcaatgaaacaaaggaatataactatatactacgtatcttaaatgcttccagcatgatgtacagttctctatctcctggtgatcttgttgaaagcaaagctcctcaatgcacacatgcagcacagcactagccaaattcccagacacccacatccctgtgcagggctttccacgcacgcaccggcaagatggatagagatatatcctgcagctcgatcgatccctatctgaaactgtactgcctgtgatacgatcttactccaactctctgacggataaggcttcatcttgagcctctcgcagcttagctatatctctctgctgccgctagctgatatggctctctcgtatccagtcccgatctcgatctctctccaactgggtcggccatccatcgatcgactcatcaattcatgcctctcgatcgcgagcatatatggtcatcatcgatcgatcagttcatttcagttgctggatggaccaaatcctgtgccttttgagatcgatcgatcaaaaagagaaaggatcaaagctatagggaccaacaaccaacggccggtcgccggctggctcgcacatgcgcatgtcgtagtagtacatatgcgttggctgacacacatgatacacgtactacacgcatcgactggtgatatatcgatccatctccatctcatctgcatggcaatggccatatgctgcagggagagaccacaccacccactgtctctctatccactacatcttctgtaatctctcctatacctcgcaagtatatacgtgcgagtgcatgcagatcgagctgatcagatgagatcgatcgatcgatctttgcaaaggcaaaggagagagaggaggcaaacaggatggagaaggcactagctagctgtagctttgttgctcaacgtgcaatgctgggtgtagatgatggagtagggggggagctagggccagatcttggagggagaagcccttttggggatttggttctttgcacaaatgcacaatgcttgccgccgctagtggcctgcatggatggatagatggccctggggtgccaccatgcatgcatcaccggacagatggatagatcgcaacagatcacggatacatatcgatcggtacaatgcaatgcatccactgtcagcagctacaatgctagtagcctagtaccatatcgatctttttggttctcgggtaatagctcagtacgacgtactaacgtgccaaacgaaagcatgcatgcagtacttctagctgtggtacaaatcgacaagtaccacgtactagtgtacgcatggatgtgattaggctgcgttggaagaagtgttgtggcggagcaactgctatacgtacgattttttttagatgtttatacgatgaaacgtttctctcctagcccataagtgctcttgactgccacgtgcgtatgcgccgtgtgctcgtgcccgttatcgtactaagatcgtaagaaaaaaatcgtacgtacatcaatttcctattacaaacctgaaaatatattcatttgatttttcttttttagaaaaagaaaacttctgtatagaaaattttgcacaacacaccgtttagcaaatccaggaaacgtgctaacgaaaaacgagtaataagttgatttttgagttgccaaaaagaattcagccttatttcgtactcctccatcattgccaacgagtaattcttaatgcatttgacgaagttaatgtctaacaattaaaattttaactactagtaacttttaaaacttacagtttaaagacaatacaatgttatgcatagattattagtcctaaaatgtattttaaaaaattaaatatttacttgttttttatatattataatagaatcatatagtaaaagataaagatatattttgaagatcgttgtcattgtttaagacgttaaaaaactgggagagctactatatatggtatatgcactagagttgtataaaaaagatccaactctaatataattctgatgtataatttgtgtgcgagagagattgagaaatgggtggtttggcagtgtgatgcatgcatggcggcagggaaggcaaacaaaggtgcctactgttggcgcctccctttcaatgtctccaggaccgttgaccgatggtcaacgagcagcagcttagactagccacgtgcagcgcgagggggcgcgacgacgacgcgtggacttttgactgatgaggccgtgagtggactcgcggcgacgacctagtctctcttgacatcgactaatccctaattaaattaagttaaaccacattcttcccatgattcattagtgtcagttagccttaagagagattctgcgtgtgtgtgtgcgtgcttttgttttaagtggggatcgtatatagtttggccgtgttctggccagataatattagtggcgcttttgaccagagatatgcacgcgtgatttctgacatgtatggagacgatctcagtcaggttaatctgaacttggattgtagctgtttgtttaatttgtagcggtccagttgattggaacgtactacttggttaagactaattaattaccatgtgttacaagcatgtgacttaatacagattaattaattaaatatataatatttggcataacaactgtcgaaaaaggcatactatttggcagaacatcatatcgatcctaaggataacgcacagatatataatattaaatactaaataaataaataaaatagacacgctagctagactagctagcttggagtaacgggggcacgaagtcatgtttagttcccacacaaaagttctacgtcatgtcgcatcgaacgtttaaacacatgtatgaagtattaaatatagactaaaaaataactaattatatagattgcaactaatttacgacacgaatcttttaaacttaattgctctatgatttgacaatgtggtgctctataaaaatttactaatgatggattaattagacttaataaatccgtctcgctgtttactaacggattctgtaattagtttttttattagtgcctaaataccctatgcgataccctatataatactcgatgtaacacgctaaaactttacacccttagatctaaacacccccgtgatgtagtagtacaatcttgttcctagttggagtggtgcacactcccttcgttttagaatgaaagatattttggttcaatcataagtaacttttttattgaaaaaaagtaagtcatacatccattttttaagtaatagatgacgtcgttgatttttatcacgcgtttaaccattcattttatttcaaaaaaatatgtaggagtaattataatttattttgttgtgagttgttttatcattcaagatactttaagcatgatttatattttatacatttgcataaacttttgaataaattgaatggtcaaatatttattaaaaaatcatcggcgttatctattaaaaatggagagagtactaactaagcaatccagtcatatatgtatctaccaataaattgatcactctaggattaacatgtttttttttatttttaatgaaaatttctagagacatttcgctaggtgagatgaagttaaaatgacttgattgaataacagcatagctagcaaaaagaatacattttgagatttaacataacaatattcctctaattaagttttttcccttgatatatttaagtctagctagatgcgagtaaagatcgttagctttgaaataagatatataacacattttgagatttaccagaagaaaatcctcttcgtaggtatagtcagttaataaccttttaacataaaaatcattcatcttattaaaaaaatatatagtgctttcatttatttttctgttatctttttactattaaaggtgatttaaccataacttatattttcagtgattaactataccacttttcatagagaatctcccttaaaatctattgaatatagatataatatgattatagtataataacattgtaattaacttatatccaatcatacaaaactcagtgttatgcaaacaaaactcagtgtgaaggcgaagtcacaggatccagcgcgcgcatgtttttttttcctcacctccgtgcacgaatcggcttaaagtacacctgacagctaaaaatttgaaagatgttttctctgattttctatcaaaatatattaagcaaatctgatacactaaatataaatatgatgaatgataaaagcgcgttgtagcatgaacgatttttaaatatgaagaatgttcaaaagtcaacagccttctatctactacatttattcctaaatatttgacgctgttgacttttttaaatatatttaatcggtcgttttatttaaaaacttt

SEQ ID NO: 69620 - DNA, 22969 bp, Oryza sativa
cgtgacttggccggccggacggcggaggatgggatctcagtatctgtctagctatctcagttccagggtagcaccctctgctctataatcttgtagagatttcgtggcattaattatgtttcgagttgttaattagattttcaatccagccattattagtttgcgcaagtgcaaaccggcctgcaggctgcagctagaatctccagtttttaattaataaagtaaatatcaacataggccgaccaatccgtgctactggatttgcgcacagctgcacgtgtacgaccgacgaacgtgcgtcgtacttgcgagagtgtataccttcacatatgttcaaccatatagtaaactccatattgtagcatatctatttttacaagcaatatataacatcattgacttttatatatgttttatcattcgtcttatttaaatttttacaaatatatacaaatataggtaatgtttaaagaacatttcaatgataaattaagtaagaataaaataaataataattatattttatgtttaaagaacattttaatgtttacgtgcgtacgttcgtagtagtgagtgtacgtgcgttgtgagtgtctgcattgtactgtgtaattcttaaaaaaaataataatcatatttttttaataaaataatagtcaaacatattttaaaaataaacaatgtcgcactccctccgtcccataaaaagcaacatagtattaagatgtgacacattttaatacaacaaatctgaacatataggatgtgtcacgtcgtagtacgaagttgaatttttttggacggatggaatatattataaaaacggaaagagtacaatatatcttaggtgtagctatatttatggcgccatatttttcatcaaaaaatagtcggcatgtatttatattgtaagtccctaaattacatatgtaattttagtgtatttacaatgtaagtctcaaaattacatatgtaagtattaaaattatatatgaaaattcaaaaattacatactaattacatatgtatgtggggtataaatgaggtgtaactactgtgtaagtgactgaaaaaaaatcaactgtaacatatggcgccatatttctagcaactccgtatatctttagttttcgcataagaatacacgtatatggtcggtacaattatgcaactccgagggcaaagctagcgctgctgcatcacggcgcgttaggtcacgcaatgaactggataaccaaatctcatttttcatggcgtataatttccaaaatctcgatgaaagtgactggagtactatatgctagtagcaagtagtacgtatattaatttattttctatactagtacagctagctagggtgtggtgcagtgttagcaacatttcttgccgacatgtacacacttgaactcctatggctatggcgttcatttgagtatctttctgcatgcagctgtgtaaacattatctgtaattgttgcgtacgccaataagattagtttgtgctattattctctacaatcatctctgactaatctgtcaatttttctactgtgctactgcgaggaattaatgcacggaatgatcatcgtgttttcttacgacatattgctggtggcggggtgatcgtcctcacatcctgtgttgatagatttggctgatcagatcgactagtcgtttccaaatactcttttactaattggtacagttaatcgttaacatcgtcgtgcaggaaccccacacatacatacatacacacacatatatatatatattttttacctcgtttttcatatatagcaccattgatattttaacaaacatttaactattcatcttattaaaaattaaatatagaaaactaagttataattaaaaattttgatgattaattaagtcacaataaaataaatgataatcaacggcccctactaaaaatgacttttttgaatgggcaccccaatagtttacggacggatcataagtgttcgtgtatgtaaaaatcgaccctcatttttccatacagctccttaagatattcgtatgaaaaatatttttttcgaacagaccacttaaaatatccgcacatgaaaataagggtattttcacatgcgggactcttatctcacccgattgcaaaaaatacccctagaagtttcccactcctttttttattcttcactctctcattctctcccccccctcacccccactccactcctctcctctcccgctctctctccccatccggcggcggcgggcaacgatgatggtgagggcttcctcctccccccctcctcctctcccttctcctccatcccgacgttggtggagggttcgggcaacaggggagggaggaggaggggcgcgatggcgtggattcgacggcggccaccctccccccatgcaacggtggtggatcgacattggggaggcactggaatggcagattcggctctggctctagctccagcaacaggagcgggcagacccggctgcccctagccggcttcgaccaacgacggcgacgacgaggagggcggcggtttctagggttatgttttcgtgatttctagtttctttttttcggatttctatttttacgtgcagacgacataagcacccacacgcgaaaatcgtactttcgcgttacaaaaatagcgagttccgtagaccatttggtgtgtgcggatcgttttaccacctgcgaaaaccagattagaccatataaaaaaaccgaagtcatatattaaaaaacaagccacaacaaaataaatgatagtcaacgcgttatatattaaaaaaataaacaaatgtgtgtgggtatagaattaaatttgaaaatacactgtttattcattttttttcttataaatattcgggatgtaaaaaattttgcgtaaatatactgttgatctcgcataaccattgcgcgagaatgacgtgggaatgacatcgtggacggtatcgcgcggcgaaggcgcgagaccgcacggtatcgtgggacaacagcgcgagaccacgcggtctcgcggaatggtatagcgagacagaacggtctcgcgcaagcactgagcgagactggtgccacgctgattcaattagcgactaattatcttgattagcgaattattaattaagcactaattaggataattagttgctaattatcattagttaattgctaattaagtaattaagcactaattaaatggagccggtggacaatttcgctgtttgattccgcgagaccgaacggtctcgctcttccattgcgcgaaaccgcgcgctctcttgccttcgcggcgcgataccgcccatgacgtcatacccacctcggtttcgcgcaacggttgtgcgagatcgacagtatatttacacaaaaaaatttgcatcccgaatattcatgaaaaaaaattgaatgcatagtatatttttagttttaattctaagatgtgggccctgtgattctatgaagaggaccgaacgtagcaaccaaagcagataaacagtactactccccggcggcccggcttaatgccccggatatggttgcagttgcgcaaggaaatcttatgcgtgcgtgcataaggatcgtgtgcccgtacgtgcgtctgttcatgtatgcgtgtgtgcgtagtatatatgcatgaatatgtcacagtacgtaatgcactcgtaagcgttcattctagctatatatacccacatcttacaccatgaaactatctcgtttcaaaatattcctctcagcaaaaaggtcgttgtcaaaccttaagtacttgtgtggtcgtattcctatatattccacacatcctccggtagttttctttatgtagatgtttaatttaaatttgtactaattgggattggacttttctttaagaacgaaatcatatgggcgtgggcacgtaccaccttgacagacaggcacacgctgacagtgaaacggaaatcctaatttggatcggtgtacgctagctcgcgattaacatgacagacacgtgcaaattagtatatatcaatttcccagaataaaaggtaaaaaatcacctacaaggctacaaacacgtatatagtcggatcaaaataatcatcgtgaggtgccaataattaaggtaacggtgtggagcaagaacccaacaaaaccaaaaaccagacacggccgtacggtgacatcagaagagatgttctcgctagctacgtgctgatcatgcaggacatcgttggttcgcttgcatgtgcaatgccgggtgacacgatcgagatgtgatgcgatgctatctcggcgcgagttaatgaggatgagccaaaattagtgctcgcctcatcatatccccggaatttgactgtttgaaacgcctgcgcgcaggatcgatcggctacgttgtctgtacgcgcgcggcgttctcgcgtgacgcactttggcagatccatcccgcaagagatcatctcgatcggcgcgtcctctcctccccgtgcgggccgggacaaaccgtgtcgcgtcacgtattttatctccgtatatctcacggcctgcagtccggctctcgctcgatcgcccgtccgtgcgtgcatgaaaccaccatcaacacatgctcgtgtcgatcgatctgtataccacgtaccactacgactacgcaacaacacatgagtaggtttttgctctcaacatgttccgttttttcccactagaacgtaggttgtgctagcttttaattctggcacaaggttgttgcagcgatgtgcatttatgtgccagtaccgaccatgtgtaccaaactaatcggattgatcgatcgatcggtccaacgcgcgaggtgccggcctgtgcacgcgcctatccattggccgcgccgcggaatcgtacgtaccgctagctgctgggctcgatcggtcgatggaccggccggttccctttcgttgtcccactccgccggcgacaactgtgcatgccggaccgagacacgccggatcctcggcctgagccagcggccggccggggcggttccaccaggtgcatctcctttgatcgatcgatcgatctcctagacatcatcgttgttagtgatcaaagatgtgatgggcggtacgtgcagcattgattgctcggcgtgacgatctctccaatcggagcgatggagcggcacttacgacgagcagagacgggacctcctccgtgtcattaggaaaggatcgcacagtggacagatgatgacaattgacagtctggtaacaatgatgatatccttatattaaaaaaaagaagaatgataggtgatatatatactactacgtagcatcacagtataattgaggagaaggattttaatcactcaacggccggtgagccgtccagaactacgcatcgatcaatcaacgtcttttaacatcgactaaaaatgtttgcgtgccacggttactagcgacacgaatatatcgagtatatagtggagtactacgtgaagggatcaaatcaaggtggatgaagacgtaccgacacgccatcgccttcacgttattacatcctaacgctgtgcacagtacgtgcccggtgcccctcgatcgccctcgtcttataaatgcagaagttgacgcctggcgtacgtgacgggctgaccggcatgcatgcatcgcgtgctacacaggtgagggccggccgggagctagcaacgcactcgggacggcgcgctttaacgcgcggccaaattaagcagcgccgcggaacacacaggactcgaccgatcggcacgggcgggcgcgcgagctaggtgccgaggtggcgacgtcgcatgggcgcatgcaacgcccagcaggcacgcacgcgagagacccgaccgatcgacaaacgtgcgagcaattcgatccgtgggaccgaatcgggcagggggatctctcgcgatatcgatcgatagcgatcgagcgccggcggccacgcgaaacatgcacggtcgttgattagctacgagagcctacgactctagcaaggcataggcacacggaccactggcgccgcgccgggcgcgcgcgcggtgccgggtggccgatcggctagctataggctgctgcatgctggatcggaagggaataatcttaggtcgactccagatcgacgacttaggtaagcatatgcatgggaatgtccgtttgctgctggatggtccagtagatggtcctatagctcgcaacgtacgtactgccattaccagaaggaatggaatgcgatcgatcggtcgatttgccggaacactgcaattaatgctgcatttgagcaagttcaatagtatagccaactgttggctctaaatcatatatagccaatttaatagcccattcatataatagttatctataaaaatatacacattattaatacctagtcttacctctcatacactcataatgtattagagttcgtgttgcagcgacttcaaatctgtagcccgatttcttctctctcttctcttttcttctcgatatgtgattatagctggcttatagcctgctattgtacctgctcttatgctcttgcgacttgcgaggccggtttttggttgctattgacttgatttttagtctttaatctattttttttccgtttgaagaaaaaaaataaaagcattatttatcctttttattacatagaagatgcacacacatctcaacacacgcgttcaaagagacaaagactaatggtagattttttttttactttaatccatacggttctgaccttttaattagataacgatatggacttcaaaatatattctttgactataatttttttattgtgcatataaaaagtaagtaattatttaaaatatttttaagactaacatatgtattacatatcatgttctagtagtctcttcaatccaaaaactattagcaattaaagttttaattgtttgacctctgtctagtttaaaacatcaagaattacgaaactggatgactgtagtactaaaatttgaaagttgtgtatcactccttatttggtttctcctacattactcgatttttttttgtttcagaatataccatctgaaaactcaaaactgcatgtgctattatcttttacttttatgctcccaattcattgtgtgcatttattgtgtaaacaacgatccgacatttattgtacctcccaattcttccctcctcccatctatccacatccactatccgtggagtcgctttagttaggacgatagcatcgttttgtattgggatgacaggaatgcatgcatatctcacacttctgaaagctcggacgcactaaactaaggattgattagaaagagtggtgagaagaggagagaaaagaaaaatgtgcctccataaagcaatatatgggccggtaatgtttctgatttataggataatttaagaaatgttttgtgtgttatggatgggtcgtaatctaagggcccctttgaatcacaggaatgaaaaaacggaggattaggaaaaacataggattctgacaggaatgtaagtgtaaaacagcggattgcaaaacacaggaaaaacataggaatgaccgtttgattggaccacaggaaaaacacaggaatttgaggagagatagactcaaatgatttcttccatgaggttctatctcttgttaaaattcctccaaaacttgtatgggaagaggcattccataggaatttcataggattccatagggtttattcctttgatttaaagggctttgtaggaaaaaaaatcctataggaataaaatcctctaaaattcctatgaatttcctttgaatcaaaggaggcctaactatacgtcgtaggtgggttaaaattttattctgtttcaaaggtgtattctttattttttcacaaaagcgcaaaagaaatgcacgtaagtatagcagtagaaatagtgttttttctgttatataacgcaattgaccagactggccgttaaggtgtattaattcttttattaattggcatattttgatatgaatcatcatgcaaaaaataatacatttgaccagcatcaatttgtttaaaacaatccagataaactaagtaaaacatattacctggtgccatgaaatctttttatgaacgttatattatactccctccatattttaatgtatgacgccgtcgactttttatctaacgtttgaccattcgtcttattcaaaaattatgtaattatcatttattttattgtgacttgattcatcattaaatgttctttaagcataacgtaaatattttcatatttgcataaaaaaatttaaataaaacgaatggtcaaacgttagttaaaaagttaacggcgtcatacattaaaatacggagggagtactatatactaaagctgaagtaaaagaaatgcaacatgaaaaaaaacatttcggtgagcttgaaacatcagtgtgggctgattgattacggcagagcgtgcaagcaaaactaaagccgcagaaatgctttacgtattttgagatgaggctgggaaattaaaaggtatgtcgtcacttgaattttgaagtggaaatcggtactacaaacagtacactttgtgctgtacgttcagaccacgcaacatatcacaggtactgtacgtatatatacgtgcgtacaacacaagttgataatcgatcatgacctccttgcattggtccctatagctaactcaatgtcttggatcgatcaacagtataacaacttatagctcgcgcatggctagctggttctttccatgtacgtttggtacatgattggtgcacccgtatcaagttgcaaatccacaacatgctcgcgatcaattgagaaatggaccactcactcagttcacacaccatgtatgtatatatatatatatatatatatccaatcaagccctctatagtgtgactagtactgtctcgatttatttcttcttgatgaacactcaatttttttttttgcttttatgaacactcaactatcttatatctcagccaacgattgagccacatgcttacccttacatcatattacttgaatgttggcgtttgatccttatttggtgaagctcgagattctgagtagcggtgagaattagtttaaaaggacatggattttaagctttgtattctaaattctacaattacactaaatacacataattaattttaaaaataagctgcaacggctagaatctctaagccacggatatctcagagctaatacgcccgactgcaggatgcgatcatatccggatcaccttttatacctatacctatatagagagctagatttaacctagctcgcacgaccaagcacgtgtacgcactacgcactctctaccgtgagttaattcgcgcgcgtgcattaactggagtctggaaatggtctctgctggcctggccggccggatcgacccgggcggccccgcgtcgcatcatgtaacaactctcacaagtcgctcgtatccccacccgccaaccatgtcttgtccctcacgtgcgcgcgagcacgtacatgtgagaaaataccatgtcctccgctccgattccccagcgcgcgcccctcgcccggccgaaaccaatggccgaattctggtgggcgtggcgtgcggtgcagcgccgcaggggtcgtcgtcggatgggagagtgttcggaaaaaaaggcgaaaaggcgcggacgcagcgtatcctgccgcgatcctgtgcaatcgaggatgtggatggacacaagcgacggtttgctgtttgcattgatctctctcccgttgttcttgccgttaggtggcgcctagcgagctacggttggagctagctagccatccacgcaagcagcctagtatgagatatacggagcatgtgtgtgcgcaagcctgcaaggccatccagccgcagccatgccttttgttgacacactgaaaccgagatgttgaccatcagctgctgttattactactagcacactgctagttgcacatctttctcctttttagctgaagatttggtgcagctcgtactttggtaaaatgccttcctgatcccgcagaaagcgagcggattcggggtaaagctcgatgctgctgtagattctccccatctgcatgctctaacgaaaggttggtcaagatacggaaacgggagaggatctggatttcttttggttaactacctgatctcatctccctaaaaaagctagttagcgactctaagattggattatagtacgtacatttgggccttccctcgagttaacacgcctaaagaactcatctagaaagttcatcgcacatggcagcaccaggacggggagccggccgggcggcgtacatacgtcgccttagatcccatttgccaatttggatcatatcgatcaaagtgaactaacccagccagaatgcaagaggagaagtgagatcttgttatctctgaacctcttgtcgttggttcagtatgatataaattcaggccgatcactcgatccccgatttgtttcccttttttcttttgcgattggagtacggatctagttgggcgtggctagctgcctgcctggcttagctgtaattccgaattctgcaccggccatcatatgctggggcgggcgagtcaggcgcgaccgcgcgagatgtgcatgagtcgtggcgcgtcacgggagttgtttattcagggggggcggccgtgttgtgctcctgcgtcactcagctttttctctctcctatcctcctcggtctccccccctttcccactttgtcagttcgtcactccaccaccgcctctctctccccgcctctcgcctataaataccgcccccctcgcctcgccaccaacactcacctcaccatcatctcttctcctcgtgctcgtcactcgcgagcaaatacatcgccatctctcctcctcctccttgtcgtcatagtgcacgcaaagaaacacggtttgcaatggcgtggtgcttggtgttcatggtgttcttgatctactgcctcatctcgactgtcgggctgccggtggcgccggccgacgaggcggcgatgcagctgggcggcgtcggcggtgggcggctcagcgtggagccgtctgatgtgatggaggcgtcccttgactttgggcggctcaccagcgccgagccgctggccgtgttccacccgcgcggggccggcgacgtcgccgcgctggtgaaggcggcgtacgggtcggccagcggcatccgcgtctcggcgcgggggcacggccattccatcagcgggcaggcccaggcggccggcggggtggtcgtggacatgagtcacgggtggcgcgcggaggcggcggagaggacgttgccggtgtactcgccggcgctcggcgggcactacatcgacgtgtggggcggcgagctgtggatcgacgtgctcaactggacgctggcgcacggcgggctcgcgccgcgctcgtggacggactacctctacctttccgtgggcggcaccctctccaacgccggtataagtgggcaagctttccaccacgggccccagatcagcaacgtctacgagctcgacgtcgttaccggtgagcaccagacaaaacctgtacagcatctcctcaaacttcttcttccccacctcctcgccccaaccaaccttccgccatgcaagcacacacgacagttatccctcgtaagtttctgacgcgtgtccgtcaccgcgattcttttacagggaaaggagaggtggtgacctgctcggagtccaacaacccggacctcttcttcggcgcgctcggcgggctcggccagctcgggatcatcacgcgcgcgcgcatcgccctcgagcctgctcctcacagggtacaccccgaaatcccacccagcccagccgtcacacccaccactggctgcgtacgtacgcacgcgcgacacagtcacacacatcatcggatcacctcactcttctcctccttccgttgagctgatcgagcgagcgatatgatggcgccgctaatctacccgttcgctccccgtgcgactttcccttttctcggcgtcatctcactctccctccagggcttggcacggagcacgacgtgacgacgaccccgttcttttgcgtcaccgccctcgctttccaactaatggcccaatagggaactgaggcatcagcgagcagccatgcaagtggcggccgggcgcgccacgccgcgcgagggaaagcgagcgattgatgcgcgctgctgggctggctgatggcctctcgggggatctttttgttaagtaccgcaatttcaccacatgtcgatcgaaaccccacaaaggggcacggggcacccaattgaaacgtgttgccaattgtggccgtcgcaaaggaaagtcaccgttgggagctgacacgtaggacaggatcgatcgaccagcgaccgagcagggggtagtgttaactttatgttgggtcgctgttgaggtctacggtctccgagaaaaagcgtctggagatgggatttttttttttgtgtgcgcgtcgggtcaggtagtggaccaggttggttgggaatttggggccgacccgatggatcgaccgaatagtttgtgctgaccaattggtggtctgcttataaatatactctatatagaagcgtttggttagctgatcgtgcgatcactcacaagattttgttgtcatatgcagctcaattagctaactaatccatgctaactaagcgtgtgtgatctaacgctgattaagctgtgtccatatgatcggtacggcccgtgggtaataataatttattaatttgtcgttctgacctgcattgccaggttcgctggatccgggcgctctactccaacttcaccgagttcaccgcggaccaggagcggctcatctccctgcagcacggcggccggcggttcgactacgtggagggcttcgtcgtcgccgccgagggcctaatcaacaactggaggtcgtccttcttctcgccgcagaacccggtcaagctcagctcgctcaagcaccactccggggttctctactgcctggaggtcaccaagaattacgacgactccaccgccgtaaccgtcgaccaggtgcgtgtccgtcgtgccggcgcgatcgcgcggccggcgccgtctttcctgattcaccaataattctctgcctccccccctgaccgcccatttgtttatgacgaaatttcttaattattcctactggagtagtttagtactctaatggcagggcacctagtcaatcattgggccatgtttttagttagttatgggcggtttagtcaagctctctagtgtaatccaagcccttgatgattgtatgattgcacccacatgctgagcacagtggatcggtggatcttgcaaacgtactagtagctgtctagatcttagtcccactgacaaaacatgcactattttatcgaccacttaattaatcaattaattacgcagtactagctattaccactagtatagtactatacgcaagtgatgaaaaagaaagacgaagtagatcattctaaactaggagtttaaataattagtttcgatttttttttccaggacgtggaggcgctgctgggcgagctgaatttcatcccgggcacggtgttcacgacggacctgccgtacgtggacttcctagaccgcgtgcacaaggcggagctgaagctccgcggcaagggcatgtgggaggtcccgcacccgtggctcaacctcttcgtgccggcgtcccgcatcgccgacttcgaccgcggcgtcttccgcggcgtcctcggcagccgcaccgccggtggccccatcctcatctaccccatgaacaggcacaagtaagcagctcgccacactcatgcccccatatactatatccagccaatctacctgtcgtaacagtaatccagtagcactcgcgcccgcagcgtcacatgaagcgcggccgtcctctcacatgcggcgcaacacgggagggcgcgggcaggtggccgatgggctgcggcgtgcgcgcccgcgcgcgcgcgagagagagcgtcccatgattggcgcgggataaacaaatatacctccagatgggcagcagattgcacaggatggatcgtgctgccgccatactttaattccgaaacgcagccgccgcatctccggtgactggaattggccgcggacataccgcgcactagggcgacagggccctattctaatcgctgcgtggtggcgccatgccaatgctaggaacagaacagaacagacggggggcgggcgcatcatcagtcaccttcaccgccttgcgccgaccggttattctaaccagggcgcgcgccgctcccgttcccaatcgcctttccacggcaccagttgttaagcttcgctagtggccagattgcacatatgtgttgtcgctttcacattagtacttaacctgaaaggacgtgtcgatcagaatcagcacagatcttgctgctaactgttgttgcttttcctactctgctccaatctttcctctctctttttttttctcggtggatttaaatactaaagagaacttgatttgcgtacgttgcaggtgggacccgaggagctcggtggtgacgccggaggaggacgtgttctacctggtggcgttcctgcggtcggcggtgccgggctcgaccgacccggcgcagagcctggaggcgctggagcggcagaaccgggagatcctcgagttctgcgacgaggccggcatcggggccaagcagtacctgcccaaccacaaggcgcagcgcgagtgggaggcccatttcggagcgaggtgggctcggttcgcgcggctcaaggccgagttcgacccgcgggccatgctcgccaccggccagggaatcttcgactcgccgccgctcttggcggagtcctgaaacgaagacgatcgacgaacaagatgatggctagctaggcgcatgtaattagtaagaatcataacaggtgattagttagtcttaatctgatgtgtagattcctcgccccataaaaaaaaatctgatgtgtagacaattctgtacagagggatgtatcagtttcatgcaaaatgtgtgcaatgtttttttgccggtaaaagtcggcgtctgcctccagttcctcttcgaagcgtcgtagttacccaaggacgagatatctcaatcactgatccatcaacaggttcaggccctgttccgcatggactaggaacagattagtgacagaatctggctccttggcgagttgtatcgtgggtgaaagtcaagttcgaaagggaaagaaaggatggttacctgatacacgtgttttggcccgtcggtccattgaccaataccataccagcaatgcctactgtaactcctgtctccgttggggcctcacatatacagtagtattctaggttgttgcactactcctaaacagcatcaaaggtcgaattgtactacaactagtactcaaactattgacagtaccaaggtactatactacccaactccacactgcaaaagatcctacttccgtggctgcaaattccgttcttccgttcatgcacttaagctgctcatcgacccgtcaggcagtgcaacgtcacgaaggcacggagcatgtccactttagcattacacaagaccgaagacttcaatgaactgaaaatcaggcgagtggcgacgcgcgccgcgcggagccgaacagaacagaaacgccgggttcccgggcggatcaacgggatggcccgcccgctgccgagcagcaaatttgcccagctttggtgcgtgcggagacgatgcgtaaagacgaaaaaagcagcgagaccgcaacaggcgccggcaagggaagggacggcttcggcggcatgcagcggcgggaacgcggccaggttcaccggctcttttccgttgatgcgcccacgcggcgaagtctctcgcctttgacatggcacccgtgttgctccacccgtccgtccggtcccccgtacgcgaacgcgactacgcgagtggctggctgtttggcatttttggctctaccaagagacgtcgcgaggagtcgagcaaggacgaaagcgtcgttcccatgcctgacgtgccgaaaagaaaatgtttgtcttctctgcaccatgaacagagctgcgatatggcaggatcgatccctctttcaccagggatgcaggcggtggctgcccggtctcatcggcaaaaactccaattaaatttagtattgatgagtaaattgatgataaaatttctatagaaaatattgaagtttgctcgagctaaaaaaaaatctttcagctccacgcctccaccactgaattcggggtgtgagattgtacggtgatgctactgcactgtggcttgatgccctgagcctgattgtctgataatttgattggtgcctgtgaatgtgattgctgtgattgattggcgtggctccggaaaatctggatgctggactcgaatggttggcgccattaaccagatcagtagaataataccagttccgttctaaagtaattatttttctacgattaaactttgtgttaaaatatttatcactctaaagtagtactccatcaccctccatttaaatttctccctattacaattatcactatatactcttaaccatacatcgttaaataagggttactatagttttttaaaaaaaaaacttttatctatatttaactagctagaatgataaatacttcctccatttcaggttataagatgttttgacttttatcaaaatcaaaccgcttcaagtttgactaggtttataaataaatatagtaatatttacattaccaaattagttttattaaattaataattaaatatatttttatactaaatttatcttaggtaaaaaaattgatattttttttctataaacctgattaaacttgaaacagtttgactttgaccaaaataaaaacataacctaaaacggagggagtattttggtacgaggaaatactaacggcaatcttgttcggcataagaacttcttcaggtttacaagggttcacggaactcgtggcccaacacacgggaatgattgggccttcaaaaaaggtctctcatgggccttggcctgtctactccatcttaagattgaaaaattgatgtcccatactcctatttctgattagattagtctgtcgcagacatgaaaaatcgtttttcacgtaggcaagtgaaaaaggccatgttttgcagtcgctagaatcttttgttctcatgaagtaatatgttgcttcgttcaagcaaattgaattgcagacaaaaagaaaatcggactattaatataaggtccatgaagttgcccccaggattcgtcctcgaactcacgccctttgcggttgtgttaagtagtatcaaacaacatgtgcagcagtccgcgtgagaaactcagaattcatttactgtagtacctcgaacagcatctactgcttgagacgtcaaatcgaatctactcctatgtatgtatatggccgtatccgtatgagcagaagtattagaagcttaggaataaaagcagtagcaatacctgttctgttcctaatccagacgaccagcattagcaaagtcgaaaaaaatccttatccccaggtttcatgttcttggcaaaccaccgaagttgatcaattcctggttgcttcgagacaaacccatgtggagcaaaatagcaagttagttcatggtttgtccgtacgtttttcagcaaccaaacttgaaacaaaaatccgtcatgctttattataaaactatttatgatcataaagtacagatagactaacaaggcaagtgaacgggtaaaaaaaaaacttttagagtgttggcaccggtgtcattagcttcaagaaaaatgatttacttctagatgcttttttttccaagcctatttataaaattagtttttaaaaggctaaaatacagagacatacacatatatatccaatcacctttaaaaggatcattcctcaatgatcatcttgatcttggattctcgatgggaaatcctctaagcacctcggtgactgaacccataggttggccactgggtgttggctaaagccaaccacaagagttgtgatgaatagtggagacagtcggggctcttcgtagagggagggggatggggttctgcaactgaactgatagaacaataatagatcacccacaaatcactttgctttgagctatgggactgtctactggtagaaaaaaatccgtcatgctttattacaaaactatttatgatcatgaagtacagatagactaataaggcaagtgaacgggtaaaaaaaactttcagagtgttggcaccggtgtcattagcgtcaagaaaaatgatttacttctagatgcttttttgcccgaagcctatttataaaattagtttttaaaaggctaaaacacagagacatacacatatatatccaatcacctttaaaaggctcaatgatcatcttaatcttggattctcgacgggaaaccctctaagcacctcggtggctgaacccataggtttgccgctgggtgttggctaaagccaaccacacaagagttatgatgaatagtggagacagtcgggactcttcgtagagggagggggatggggttccgcaactgaactgatagaacaataatagatcacccacaaatcactttgctttgagctatgggactgtctactggtacaattctcgtcgtcagatctgccaaaacaaggtttacaatatcaacatataaacttctttatttttcttttgtgaaaactagacatttcggtccgacttgagatagcaaaccattatgtaaacatgacattttttaatcaaactaaaatttaattttttgataaaatttagccaaattccaccagcaatcaatggttttcaaatggttctaaaaaactgaaataacctcctgagagcattttttagtgccggtatgattcacatgaaaaacaaaagaactgccaagttatctatacatgttagatgatctcgaatatcgtgtgacgcatcatacttgatcgactaataaatatccaaaaatggatattggaacgtattcacatgatgtagcctctctacacgtcatcaatattatctccgcaaaatcaacttttgattttattctttttatgtttataccgcgtcataaaaacaaggtacatgtgaaaccgtactaatctactttacgccatctcccacgtccccctcttcttatatttcacctccacgccccccttcgtctacctgcttgagtattccctaccttcaccataggcggagatcgagttccacatacggtattttctactagtactctatttttttctcttctatcaccattatggttgaatatttccttttcaaatccttaacccttgaaaccacagacaccattgtaggttttttcgcgacctcgaatcatctccgatagtgtcggctaggcgcgccacccatgcgcgctggcgacgctccgcgcagagcaaacgggagattatatggtatcaaaacaatgacttatacaccagaacaatgacttatacaccagacgagatccacgcagcatgttcctctctatttctttctttcttcttcctactagtagatctagatatatgatttcaaaactttggatacatatagttttgaggtcttccatggcgtacggtgaaaacttcctttttgcacggccctccccaccattgagatcaccgtttttttttttttggcctatttgcggcgcgccccggtcggccgtccctgtagctcagtccacccaccgctctcacttccatacgcggcccgccgcacgggtgcgcatctcggcgtcagaaagggctacagccctacagtgatggatcggacggaccgtgcggggaagaaagagaaacacatcggcgcaaggcgcaacctcgtctccgccccactcgccgaaaatataaattccccaatccaaaatattacccatcccccccctttttttttctctctcctcccttttcgtctcgccgccgccgccgccgccgccgccgccgcagtagagtctgcagcagccgcagccgccgccgacgcggcggctctctctgctcgccatccgcgtccggcgtaccggctgccgacgcaggtgagacgctaggccctttcctcccggccgacacgggatcggggaggcgcgcgcgcgtggcgccgcgggcgctgatgagatatggttgcggcgggggactagggtttgagggttagatgcgccggcctgtttggtttggctgttggggattttttggagtcgcgaaaggaattcaacgttgtctcgaggggaggcgtacctgagtttctcccgcctgcttgtagctttgcgttccgtatatatttccagtgaaattcggttgcccgcgcttcgtaacgaagggcttttggttttatatggatggtacttgtgtgcagtgatcatggatttctgtgggtggattatagttattctgaagccggtttggcttgagttttgagggcttagcacaggtttgactagcctgccattttgatactgtaaagtacacatgctgatatagtgatatttctggatttctgtggttgggttagttaccctggaatcggcttggcatgagttttgaaggcttaggcgcttagcacatgtttgattagactgccattttgagacagtaaagtaagcatgttgaatttagcacatatttccttgtttctgtacacagatccgaagtcaggctctgtacggttctacgattatttgatggagcatgatatgacagttgaagattttattagaactaatgggttaggggcaagtggattgatagagaccaataatcaaggtgtatccacttcttctgtgtctgattgtcggtcctgcgagcatgtcgagaatgggagcccttccacggcccctcccttttgggactctgatggtgaagatgacgatcctggtatgcaaataacactacttttgttcactgtgatgataattaccgtaataattcaaaatgatagcgctagagtttgaaatttttatagcctatttatgggaaaaacaaacagccatttctcaactaagagttatgattagttccttaggaagataatattatgttgaaatatgtgtctggcaggccagtgctggaaactgtaatcttgagggacgcgcattaggccctgtttctttcagcttgggattattataatccagattattgggagtaagcagaaagaaacaaacaacttattgaagtagcttattataatctgttaagctcatttaggtgagctttttccagattattgggtgaaaaattacccaccatgccaccccactccctctttagacttgcaaacccaataatctaggctccattctactacagattataacaatctagcttatattaatctgactcaataatctagattataataatcttaagctgaaagaaacagggccttagtatggacagagattacatgcttaaatttgctatgaagacctgaaagaactattttttctagtcatactcaaaagtatcattagtttgtttactcctattgtttcttcctcttgtacacataacacattcaacgtgccagtgcaatgcagttgcccttctgaatattgcacttttggccacctgtacttatctctacctttaagccctatgtttcactctgggttaaataactaggttaacttaactcatttcttgtgtttggcagcagacgtagttaacctaagatactgtttagcttgattagtatctgtttagctgggttgacagttcagaagcctagaagggttaattgtgtctttttagctaattcactttttggttattcgctaatcaccatatttctgcttgtatccagaaacagttgcctgaaaacatgtgtttcttgcttgcatcccaaatacattatgttacagttgacatatttttatgtcatcatcatatgccgtgcattcctatccatgtcaatatatcaccatgtcattaagttaacgaagcttcctaaaaacttatctccaaaagtattatttgccgttgtacatatgaattatttatccacgaagaatgctgttatccattctattcttggtctttgtaaagttgaactgagtttagggcataaaaagagttttggagtacacatgctgctgtctatggctactaatatatgttactagtatttaccaacatttttgtttgacagaagtgataaacctgcgaacttcttgtcagttacagttcttgacacaatagtaattatagttccatcttcaaattaacctgttttttttttctttagcgatgtttctttctttattgtaattgaataattgcagctacatttcatttggctaatctctgtcagttacctcagggcctagaccttcagatttatttgggcgatatacttggagaattgaaaacttttcaaaggagaaaaaaagagaaatgaaaagcgaaccatttgaagctggtggttacaaatggtaggattcctgatggtaacttactagaaaatttggtcacagcaattctcttttcggagctggaaactctaaattgcttagtagctcagtttgtaatgcattctgcttagattctctattccattgactgacaaatcactcatcactaattgttatttgtgcaggtacattctagtttaccctcaaggatgtgatgtctccaatcacttgtcattatttctatgtgttgctaatcatgacaaacttctcccaggtttgctgttattatgttggctaaactatcttatgtgttcctcacagtatttaatcacacccttaacacatttcaggatggagccatttcgcacagttactatagctgtgggtaatcttgatccaaagaaagttaaatattcaggtgaggcaatctgtgattcttattgtttgaattaaacactctgtttcagagtttaactaagtaagtttgcagaca

SEQ ID NO: 69621 - DNA, 23392 bp, Oryza sativa
  unsure (1)..(23392): unsure at all n locations
tcctccagctggtccagttggacctatttaatattttaattttgcatcctctttcatgctttctccatagtttgttgttaagcaagaatgattctttttttcggagtttgttttcttgaaccttctgatttcaatgaataaatgtggttaaaacaatcaccaaactgtagcgattcattttcattactagctcttcttatgacatttcaatttgattggtcatgtaaagcttcaaacagtggttttaccttcaaaattccagtttggcatctttctgtactttagttaggagaatatttctatcttaaatattcaagttggatgaatagaatttctagaagtaaatttctctggtggtcaaagttgtaccttggagactgagaatcaaaacaaggcttctttgtgatgagacttgagtagtagtagaatgagagtgaatttcatttactttcccattttgtggtcttgatatgtgaagattgtaagcatttgtattacttgaatgcagtatagctatttatctcactgctcagtttttgtcattctcatctttctaggatggcagttctggagaagttaacaaagtttcgattgaacgtgaagaaaggcgcctaactgaacttggtcagaagataattgaaacatttgcactatcccatatattcaggtaatatatttcagttcaatcatcttgttacctccacatgattggttttctgggtacatatcataaatttgtaaaaccatttgtcctatgttgtccttttatgtgattttcttagtaccatattttgtttagtgcttgatcaaccagatgactcatgtggtcacattcaacttttttttttggcttgtatcaatgtgtaattgtgaagtggtttaatgattttgtgtggtcagtttccgagttagtatgctgaggctgccagcatcacacaggtctggtggtggcagaagaatgttaatgggtctaggtggagagtaaataaagtgattggaacagaaaccggaagagatagaggctcagttcttttctttcttaaattcattaaggacatatggcatcctcatatgcatgcccttaacctttattaatgtggcaatacttaacctatctttattcgtatcctcgctctttgccaatgcaaatgtctaggtcatgaggattactaattcatgcctctaacttgaaccctgttgcacagctcccacccaactgaacttttcttgccttgcctgacatgggtacctatgttagacttgcccataccccgtagtacgtgtccaccatatatctcatttctgttttacattgaagagtgtaccttttgagttctattattactgagttagcacgaagcttttccatgaagcctcctggtgttttgcattgcagtatctcccttaaagttccataaaaccaaacaaacagttctgtaacacaaaactggagctcatcctcaagttctcttagaaatatactggcatagtccattatctcttagattagcacaagataaccttttcatcctttgcattgcctcttacattttgttttcacattagtgggattgaggttgcctatcaagaagctgttgctttgaagaggcaagaggagcttattcgcgaagaggaagaagcctggctacttgaaaatgagatgaaggggaagcgtggcagtaccactgaaaaggataaacgtgcaaagaaaaaacaggttaatttttaacatggtcatgtcatcttcatttattttatgttagattggattttgttttactcataatgatcgattatcattttcaggcaaagcanaaaaaaacaatcgtaaggttaaagacaaagatagagaagaaaaatgtgattcaaattttccagaaagaagtcaagatgaaaacacaattcatgacagggaagactctaaacaggcaggacaaatatccatgaaagtagatacctctgaagaaggtgcctcagatgtttcagacaatttagatgggtaattgaggtatgtcaaagttccaaactgacacagtcaataatatttcaaagcctgttaataggatgaatgatgttgatgttgagatgaaaaatgttcagattcagaagaaacattctactatggagaataagtcattgtcatgttcatctgagtctgctactatgaacaatgcgcaaggcaaaataaataacttgttagaaagtaaagatcagatatcacgcaacaggttggttagcattctgtcttaattttgcattacttctcttggcaactagaatttgtcttaattgaatttatgcacagagggaaagctccagcaggagcacaagcaatatgaacattaccgaggatgtggatgatcttccatcaagcacgactagctcagacaggaatacatctggctgtggcccagctccaaagcttgatcaagagactgttctacttaccttgaaagataggcttcggaaacttgggcaacgtttacatgaggttaagttattctttataaaatattgagctatatttccactattgccttgttcatttatgttatgaaattgtcatcttaaagcatatcaccgtcaccattggtttcatggactcagttttgttgtctagtagtgctttgaatttgcttgtttatgttggcaatgaaataggttagctattctgatgatagatttagcaacaattaacaatatggtttgcaaggagtttgaacttttactagactaaatcataggatcaaacaccagagccattttattatgctaacaatatggctagacttgtaaaactcttctgtaccatttgccgattaactgcaccttctccctgtttttactgtaaggatgataagcacagtaatggaatactgctagatagcattccaaatgaaaacataactttgcattctttttggtgttaggactaatattacttcagcatcacaaatgcacacacaaatacacaacaagctagaaaatgcaagtacagaacacaggagatcacaagatacaacagatccataaacaaattcattgtgttatttacatcatactgatgcattgcatggatatgttcctgacaaaatatgctttggtgaattcacttcctgaattggaattttatttagtattttatagtcatttcatagtaacacttcaattgtcagttatcttgtgcaattgtttttgtactgctgaagattgatgtatctatttctatttatgtttgttaacagaaggaaattgagggcaggaaactactccaggctcatttggaaaagaaggcagcagctgagtcagcaactggttcatcctcatcactctcatccaattctttagaagagactccagaggttctgaagagcccagatcaatcttcagtaactatctctgatgctgatattaatgcatcaccttcaaagtttggtgccagtaaagaagtcactccagtaacaccaaccaccatcctaagcactgagcctgtgcctactgttgcttccaccctgagtaaagatgagccagttttgtgtgaagatcatgtatcatgttcaactccacaaattgatactccaatcacctcaaatccaccgcaagttgttaaaactgtacccttccttcaggcatgctgcttgttggtcacgctattcaagcaccgtctagatcaccggcaccacaggttgatagggtctctaaagctattgctgctcccaccaaatcacctgctccacaggttgataaggtctctatagctgttccgactccctcaaaatcacctgctacacagggtgagaaagtcgctaaagctattctggtgcccccaaaatcacttgctccacaagttggaaaggttgctaaaaccatcccgacaccaaaacaacctgcacctctggttgacaaggttacgtcacttgaccctgtatcaaagcaaatgtcttccatgtctaattcagaagcccgagaagctattcttcccaaaaaggctgcagtcctgtctgtttcccaaactcctgcaatatcgaggccttcaagtgctcctctgttccaggtaccaagatcaactttaccacctacgccagcagttcaagttcccccaatgctttcccgctcaatgaccctggctggacgatcgaggaatgaaccatccccttctgttccaagttatacagcacagacctaccgaaatgccatcattggtaagagtaatcttgatacagcatcagcaagtcttgatcattcaacttcttttggccaaaacgtcgcactttcacagccactatcatcgtatgcatcagcagcatctgccatggtacctccggtcggaaggaatggccaattaccaggtaaacagggcttcatgtttgggcaaggaaagtccgaagcaattgataactggaacccatggaaaggtgatagtaatgctaacaaatacatgtggaaagatgattctccttaccatcaaatgaccaagggtgatgcacatactcaatcttggagggacaattcttatcagcaagcaggatgcagtggaacaggggaacaaggcgaatttggggggcttcaatataggcagttccagagggagattccaacacaccttgtctcataccaattgccagggccagttggagaagaatttccacaccttgatatcatcaatgacttgcttgaggaggaacaaagcagtgggagtatggcagagcctaccctccacggatatcatacattgggcttgccgtattcttccagaggaaacttagtagactctgagtgacttccataagtagttctggccggttaaacttggccgatcattactatgacgagggctacccgatggcttatgacaggctgaatgctctttataggttaagagaagggcaaaattccacattggatgcttattccaatggaaggatggactcgattacttcaaaaccttggctacataacttctcaaatccagcagtgaaccttggagttaacccaaatggattttcacagcaaatggggaactacaccaatttagggagtgggagggtgaatggagaacatctgtatcgccatgccaacgggcaatggtgatgcctgtacacaattgataataaatcctgctataagttgtcacagaccatggtggcagatgtaagcgtcgccatggccaccaggttgtaacttttaattttaaaggggcaaagaaataatacattgtgtaaagcattccagtgtccgttaaattttctgtcggctgctttcatagttttatggttcttctttatttcttttttggttggagtataaaacggaattttaacaagtcagtccagaagagttctatgactacttcatcgggttggaaagttccagattttgcatatacgtgtttgtggttttctcttacaagcctaaaaaatgctgtaatgggctcggaaacgaaagaagtgttgtgattttgcagtggcaggtcggatagttggatgccaaggtaacggagctgagatgttccagggtccaaataatgcaagtatgcagcaacctggagaagcaattcaaaactgaaggtaccatcgaagtctatttcaacttcagattatatacccacatgactcctttgctgctattaagatgaacaaatctgtcttggagtaatacaattaaaaaaattatgagcaaacccaaagctcaaaaaaatgaaaaacatgcacagcttacaattatgtctgccttgtgtttaatacaagctttttctatgcaatttccctcaaactagaacagattgccaagtatacaatttacaagatggatgggtatctgctatacaaataagttgtgtaaaaaactaaaaagaagttgtgcgtgttatttactaccagcaattgctcgcagttctcttaggttgctagcgatttcctgaataaacatcacaccttctttgccattcctgagtgagtttatgctatgttcaataaagttgcggtctccttctagcgtcttcaatcttttgttcaagtttgagatttcttcttgaagcgtgctaagatcagtcttccgactcactgttgaagaatgagcttctttagctaagaaaacgggctcctgggcctctcttgagctttcttggcattgcagtgagccatcatctacaacgtgcattttgttggaaaggaatcctctatgacatctgaatttgacaagtgaatgttagtactgttgttggagtaggattgaagcttctgctccagcttcgtcaagcaatcaactatatatgccctctcctcttcaaagctcactaatgaatttataccacttggtgtggtaattgcaggagcttcaagaccagtttcatcaagcaaagtttcggcaatgttttcttcattaaaggagacctgattggattgtttctctgttggtccacctgcaaactgcatcctgtagttttcgagctcagcttccaattcctctatttgttgttccctctgagcaagtagctcgttagctttagcaagcgcatcactatcatactctgcttgttcttccatcatccgctggtaatgtaaagcttccatctgcatggcagccttgtcatcctgcaatctggtaatcatagccaaagcttgacttgcagcaatcgctgaagcgttcctttcttcttccagttccttgcagaggaggtgtatagattttcggtcaagatcaatctgtcgtctcaaccgttcagtggcactttcaccttccatctcacttacagtgctaccctccagtgactccaaaccagatgcatttctctcaattgaaattctgttcgtgatgttctgcactatcaaatcatcaccacgcccatacgcacgtgggctagggcctgggtcgacccatggagcctcgagtcctctggaagccgagagctgtgacagcagtaacctcaattcttcatttacactagaagaggaatcctttccaagaatcacatcagtcaaggtgggggatggcaagctactcttggcaccaatggcaagcttgtaggcttcattcatgctaatctgagtgcttagagatggtctcctttcaccaatagtcgcgcttgtttgcggatgttcctcgatgacattgagaccctgaaatacctcactgtttggtctaatagcctgtggtgatataggagcttcttccacaaaacctaaccaaaagggttaaatgtaaggaccagtttttgaaatactgttgcttgagggaaggtagaaatcaactaaccttttgctgtaggatctttggaatttgtattggaaggatctttgagtgccgcttcatgtgttaccatatcacaagtctgttcagcctccttagcataatcttcagcttcatcaacagcttcagaactagaattaacttgtgaaacatggtcatctctaaaattaactgaaagggaaaacaggtcggaataaagaaacctttcagacatatatcttgattcttgagaaatagtcagtcctgaggtacagccttacctggatcatcatcaaccaatgcacttttctggtgaaactctctacttgatgtaacagtaatttctgacctgtgaccttccagatcatctgacatttttttattgtgatggggggttagacgaacaggaagaaaataccattcagtttattgttaaactatgattaagatatacctattgtgctgttgtgctctgaaacagcaatgttttgttctagtgttgtggactgtgatgaacatggatcaatggtgctttcactcgctccatgacatgcctcgttgtacccaagattctgaggtgactcgacacttgatgcaactggaacttgggaaacattgacatctgcatgattatctatgctattaatctttcaaactgaaaaagaagttcagtaggagtcatcccagtttggggaactaacagttacctgtcaaacctgactcttctttgacagctaggggatcatgctggcatgtctgtttttctaatgaagcatcttctgcttccatttggccctcaccaattatactatcaggatgatcatctacaagaacatatggcaaggatatatcatatgagtcaccaacatcggtttccatcggaacattcatttctaatggcctgaccaactcagtggaagaagcagcaaatttctcggcagtggcatcttcattcaaatcttcctccatacaattggttttatgatggtgtgaaattttgccatcatcagcacagggagcctcatcctcggagccagatgtcatctgcagcacactgtatcgttcatggatggagtgatcactctggtgacaaatatctttatccaaagatttatccacttgatgaagtatggaataatctgtgcaaatctttggtgagcaaacagcctcagcaggttctagttctgtgatcattcgagaaaacattgtcggtctctgttgtgtataatgctgtgcacaacatgagcaaattcttgtatcatgggaatataatccttgattactatcaggtagagtggcagccattgttggctcatcggtgcggtcatcattgttttctacaagtgagtcactgcatctctcacacatactttgggcacctgcaagtttctgatgtagacggcagaaggccaaagatgagatctctgacttgtgagttttgcagatcaattccctgtagaagcatggtttctcattacccaggacatggtctagccttgagcagaaagggcacggtgccggtaatctgcagaggcgggcaaatctggtgaccaagaagcaataaaccgcatcgatgaacagcagcagcatcaagatccactcgagcaacaccgatgacagtgtggctgacaatctccgtaaggttggcatccttgtacccatctttgaacagtatgctcaattcttcacaattgctgtactcaagttctttagattggtgaaaggtggctggtgttgaaccagaatttctgaaggaatcaaaaacaaacttaatgagtgaagtgtataattgatcctactaatgagtaatgatatgctgttctgaataacatagcaactactcatcaaaagctgtaaacatcaaagtttggtgggattaggacggccttttatctcattattgagcactgatagaacggtaaagtaatgatggcggtgtcattgtagcggatatgcttgattttggtgaactaaaggcgagcttagctggagaaaagacaggaaaaccgaacaccaggttggaaaaccactagaaaacagaaaatcaaaagcgtccagctctagcagcagccataatggtgatcaatagacccaggaccaagagaatgttggaagcatcagtccaagtagtaattgttacaggacaatttcaagaagcattaagaacagtgatgctgcacagaagagctttcttttgaatcccacaaactccgatgatgaaagaacagctcaaactgtctcttttgtaaggggagaaagaaaagaacctctttgaaagcttgaaaaaattttaacaccaaaacagactaaactcttccagaaaccacccagcaacagaacaaaatccgatcaaacaaagagaacaataagcataaagctaagcaacctagcactactatagcctgcacagcggattcccctataattgactagcctctcccatgtaagaacagaaaactcagcaaaatcacaccatccaccgggtgtgctcccgagctctccaaactacagaagcaacctagaacccgagctcaccaactacagaagcaaacctagaaacgaaagctaaagaaagcaagggaagaagaagaatgttccgaggatcatccagcaagaacatacatacctgcaagctgcagcggggtcgccgcagcgcgctgagccgagatcccgatctgcgatcgcggcagccaggcaggcaggagcagagggcaaaaagagagagagaggagacggaaaaggttggcatgcgccgaccaaactcgccacgcctgagctatattattcccacccgccggaacgagccaaaaacgaagggaagggagacaaagagaggaagcaagtggagtgggggcggcggcggcggcgggggtgcgacgcctcgccggggcggggccggcgggcggctcaaccgaaagtcggctacgcgggccggcccgggacagcgacgccaccccggtcagccagccgaaaggtagtatggttggctggctcttccttctcgtctcctcgtaatactgtacaacatttgtattttggaacacgaaatttgtttagcccttgtttagttataaactttttcttcaaacttctaacttttctatcacattaaaactttcctacacacacaaactttcaacttttccattacatcgtttcaatttcaaccaaactaaacacaccctattcacgggagatgtgatgactactactccatcattttgtttatttgagaaataagctaaacaatatatttgtaaaggaatacttactatgtcaatataagagattttaatattttgcttacactgtttaaccattcgtcttattaaaaaaattagaattattatttttttgacttattttattatccaaagtacttttagcacaacttttcgttttttatatttgcacaaattttttgaataagacgaattgtcaaacagtgcaagcaaaatgtcaaaatcccttatattaggggacggagggagtaataatttgtaaataaaacttttaaatacgtgttttaacgatctaaaagcaaatgctaaaaaataaactacgatggaaaaaccttaaatcaatgaaattttaaatttcggctgataagtataagagtcaatccattttatgccatcgacaaagcgcgggtctacagtatgccactgacaaaactcagttctacaatataccatcgaatgactcattttcttccttatatgcaatcgacgttagtcaaccgttagtcaaccgccgttaaaagatgaaaaatgaccattttacccctagcataaaattgagattttgcataatgccatatcgcggtaaaaaatcttggatgataaaaagacaagcaatttctatttttcatcaatgagaataaatagtggatcatgatcagtgaaatcgatgaggatgcatcgtaccctaggggtaaaacagatattttcttgctcttaacggaatttgactaactgttgaccgccggcgatggtatgtaaggaagaaaagtagttattcgatggtatattatagaactgagctttgtcaatggtatattgttgaatccatgctttgtcaatggcatagaatggattatctttataaacataagcgaaaagataacatcgcacgagtttaaggttatgtgtatttttaattgtttggtgcaatttttttaattgaatcgcacgaatttcatgtgctccgaagagtgaatcgcgtgttaatatggtttgactgtactggtctcaacgtacctccggatgtagtcaacaatgatgtagattgttgtgctgccggtcgttgctcgcagactatggagttaatcaaatagtaaatcagctcatattacctttttttgcaaattagtttaggccgttttctatcgtacagtgtcctgtttcaaacagtataatacttgttggatactggatatggtattctatcagtatgaactaatatatattagtactagttgatatatatcagtatatataaggctgatacccgttgatgacatttgatatccatcggcatcggttggtgaaggttttattgtgagcgtgggacgcgtattgttgccgctcaggtgatgtatatgcatggtgcatttccctgcgattggttgcaagtggagggtgttaggcagttggctctcgatagtagcacctaatgagcaaccaaacctttctagttaatatattatgaactttcattatttttcaaaccttttaaaattgtaattttacgaataaacttttcctaactaaattttaaactctaaacattttgatcacgtcacatcgccttgtgtggcaaaataaaattgtcataccccccgctagactggtgtgacgaaacaatactcacttttggcagactggcgtggtcggccaaataaaacactggcacaccagtcagttcgacatggtctttttttgtcacggttgacgtggtcaaaatgttcatattcgaaaacaagttttgggagaatttattaataaagttaaaaatttaaatggttcagaaaaataaaaaagttccttagagttccaagtttagtatacgcatagactcatgtaagcatgataattgttgatatggaaaaatatcacctgatgcttcatacaattaaatattctagcacacatcatggtttcccaaaccaccgaggccggggttaccgcgcggtaaccgcggtaactgtggaaaactgtacgaaaccgtgcaaaatttatcaaaagttcaaattatttttaaacttatttaaatttaagaaggttaccatggtttttctattatcgtacccgcggtaagtccggtaaccacggtaaccgcgcggttaccgacggtaccataaaccttgtaacacatgcatatatgcatgaaacgtggtgaatttagttatacaaatattcaaataagagttagcgagtcaaacttcaacattaatatttcaagctttaattaaatcaatggctattacatcgtttgtaaaggtgttaggtgcttagggcattagcaatgcgtccttaatctgttatacctgagctgccaaatagactaggaacttcaaaagctacaaggttcacaatgcaatgtgactttaatctggacacataaaatccggagacaatcatggaggctactcaaccgacagtgagcgtgacccagcccacctcgtagtcttgtagcctcaaactcatcgcatctatccctttgactcgtcgtctccagagccacgactcctcacattgcatcgcattcccctcccgtgacgcatcgccttcctcgcctcctcccacgccacctcgccgacgacagccacggctgtgccagctcttgctcccggtgtcgatccacagtgacgacgacctccgcagctatgcctgctgcagctcccggcgtcggttttgccctacttccacggcgagcgaggagaggcgaagagcgtgggaggcgaaaaagagagcggcgctcgcgcgggagggaagggcgagcacggagagcgagtatcacgcgtacgcgaggacgaccaggagggcaatttggggatcgagggggaaatcgcgccgggaggaacggcgcggcgaagccacggccttcccagtgcacctcaacctcctatccccatgccaccgattctcaatccagccaaagcacgggtgcctaactttggtcacgcgcgcttgtgtcttgtgggcccaacgagaaacgtggcggcgattttccaccgttcgcatacgtggaccgcccgggccaaacgacagcacacgacaccgtgaatggtcttatcgtgaccgtggtatattctaacctcttattttaggtaccactgtctactatgacaacagtgatggtcgctatctctatttataatttttatgtgctttcactagataatatgtgtgaatgacatggcgtccacgaggtatgtgacgataaatcccaaatccagaacatggaaattcaaatccagggacaagacaatcagcatcggaatggccaaaatgggggaaaaaaaccagcagaccagctcattgtcacccacatccctgtctctctaccctaccatggacagctcccccccgggagccgcatcgggcggccgtcgttacccccgtcgccgacgccgcgcgggccgtcggatccccgcgcaatcatacacacgtgtcgccgtcgccctcgtcgtcgtcgtcgcggccgcctccgcggcatccgtagtactagtaaaatgcagcgcggaaggcggaaggaggcggacccaaaaaaaaaaaaaccgaaagaaagagggtagcggcctccgagcttgtgtcccaggcggcctctacgtggctcaaccaccgcctcgcgttccgcggccggggggctcgcatgcaagcctagctagcttcacattcccttcccttccccgcattgctgcgagcgacgctgcttctgcttgcttggttcgcttggccgccgccagatgcgatcttctccttcctctccgatcctctccttggcctccttcctcccgttgctagctcgtgcatggtggcttcttcttcttcttgcgccggtttggtgatccttgttgcgccggtttggtggtgatccgatcgaggacggaggaggagcgcgcgggggatccggtgatgggagaaaagctgtgaaatgagatggtggtgatgcgctactccccgaggtgggctgctgcatcacagattgatgattgagtagaaatctattatactacgtcgtcttttcttgtagatggtttctttgtgctgtttaatctgctttttctgtagagctttagtttttattttattttatttttacatatcacgtagaaagattacaggcttttttttagaaggtgaaaaattgcaaattttttgaaagaacgaaaaattgcaaattgagcgtagatgcatttttttactctttatcttggtcgtctgatccatccacggattcgtttgggtctagctaagaccgaaaggtatcaagaagctgggaatatctgcttttttggacaaaaagacacaacaagattggagtttttgcatctactagttcatttattaggatagttcgattcttgcatatgagtggaaaagaacttataatagactagtcttgactcttgactatgactcttatcagttagatggatgcccaactgcgttgttattatacagcagtataagaaaaatatgtacttttgtcatttgtaggggaactctaatttataattactttctaccttgcatgtatgctatgatatgaacagaaaattttctttttgtttatctgttaatcttttcaaagggtcctatttgatatgctccagtgtaaaagaaaaacagactcatgccatatgtcctgcaaataatcctattatcttttagctaaaaaaaaaatcctcttatcttatagtctactgaaggcatatggtggcattcaggtgcaggtgtaaatgcagtcataatattcggcatgagatctgtctctgagctggtgtggtctccggatgagggtttgagcattaaaattgcagcgtccagcttaagtacaaggaaaacttctcttcattggaatgcagataccttgagcatagtaatatcttcacctcaacagagtggtgctggggagagtggtcatatcatagatgctacagtagaagacgcagaaaagatgccatcccagttacgaactcgcagtgacagttcagcgagagtattcatgtctagcccaagtagaataagaaacactgatgctcaacaatctacttctataagatcacatgggcaagattcaagtaagtttaaaagacatgaaggttttgagtagttcaaaggcagtttgttgatgctttgattttattggcctaaggatctgcatttatcagttgttgttcgtcttagcagcacaactttttcaggacaaatctaacaagagtactgaattaaatttttgaaaaaaaaaagagagaaggaaactgctgaattaacttttcaagaaaagtggagactgctgaaattagcataatcagcacaaattgtaaagcatctctactgattgtttgctatgggcatctgttacctattatccaaatagaataaaaatcttatgggttttccatttctttcattggatggccatttcctcacttaatgcctggcttaatacctgtagaatactgtggtgggatggatgtgatgaatgaagggaaagaaacgtctgacaacttctgtgtggataagctggagaaagaggacgaagtgggtagctgtcccacaagatactgcaacgatacttcccacagtctaggtaatcaattaagaaccatgctcttttcaattcctgacagtggagaccttaccgtagcattttacaggttcagcttccagaaaagaggtcatgcctattattgctgaaaaacaggctttctgtgcaactactgtccatgatgaaagatcttgggcagctaatgcttggcgtgctcgattagtaaaagcaattagtcagaaggactctgttttgccaaagaatgcagacaatatacattcaacttcggcctttgggagcattggtaatacagaaaacatgcctggcaaattgacaagtatgctaggtaatagaaatgacagtagccaagatcaggctatgcaggaaaagcataggatgggcttattgttgctagatgtgagtccgtgtctgctgtgaatcctgttgctagatgtgagttagcatctggtgttaatcctttagcaagacatgagtcgacatccggttgtaatcctagaaagctcgagaaggggaaagaaaagcttatctatgatatgagtaattgtgttagcaacacaaatgaaggtgatgacagcaatgagagtatagagagctgcccaagtacaaaagctccgaagcggaagcatggtcaattttctgcagctgagatgacgtctggaaataaaagatgtagaagggaagataatgagagttcttgttcaggattattccacaaaaatgatagctctttctttaactggatgtcaactctcactaatggagtaaaggtgtttgatgaaactactgctgttccacttaatcagaagttttcagcagctacaggagaggaatttccaacaaaccctgtgccacttcaaaacaactgtggtgttccgctgcaatccgttggcttcaattctctttttcaatctctttatagtcagaatgttatgataacttcaagaaatacctgtcaccagtcagaaagcagttacaccgccaacaggctaacactgggtttcaagagtagcaaaccagttagcatgggcagagaaactcttaatgtggctactgagactttagctgcgggcagaattcaaatggattcttatggtgacagaggggcatttcaaaatcaaatgggaattttccctttaagagcagaaagaaatcagaatgggttccatggaagctcttcaaatgctgcatcgggacataaagatgatttctcagaaagcttatgggtaagtagacttttgccaaaaacacccatgaaagtgatggacacaacgcgctgtgatgaagaaactgatttttgttctgctaacccaaaaggtttaggtgatagttcatcaccgcaggattttaatgtggagaaggaattaaacaattcacaatactttactagcaaaggaagtgacaatgaaactacaagtagcaaatgtgcggcgcctcaagacgaaaataaaccatcagaaacaatggcatcaatttttgctaaaagattggatgcgcttagacatgcaaatacatcagcagtacatgtggccattacatgtgaccatggaacacccaaagggcgtaatcacaaaacaagttcttttgttgttagttacaatagtcatgatgagcaagaatctggacaaaaaactcacaagtcttctggtggagaaggaagaatagttttatggacaggtgacaaaggtaaggaacaattatctcctgggaatgacaaagaattaggagaaaaggttttgtctaagcatgaaaatcagaattgtgaagggagctctgatggaaaggtggtaccccctaaatgtaatttagaaacaaacacatatattgaagaaattgatcggaagagactacaaaataaagaaggagcaccaaattccatggagaatcagccagataacaaacaaatggtaccttatggtattgtgcccaatgatgtttatgacgaagcaagtgtagtttttggagccttgcagaggctccgtttgtctcgctccgatataataaggtactctaaaggattttacgtatcatctttgaattctggtacttaatcatttctaccttctatctaaatcatgaatgcttgggtttggagattccataacattttctacatttaaagaagggaacatcgaaagaatcacattaaggaatatttcattgggcaacagtaattctcatatagcttcatatggtagtctgctgtttttcagttatcaagtacttcataggggtgactgggaaaagtcaccgagctactgagcacataaaaaagttaccttctatgaaaaacgacatgtgtctcggctactataaagtagaatatgatacatctatttaaagtgaccattgctaatgagaaaatgaataatgagttgtaaaaaatgatacatatgccttacattcccctaggaagccaaaggtgccttaaaattaaaatagctttgagaaatattattgaaacagtgtctgtagtattagtaggtattttctctagtttaatactaatatcagtgtgttctggacttctgttcattgatcaaattaatatacataggggtatccctctctatgtaagtgatctccaagttagggaaaatcctgagaacctgatatttaattcatgtgtttgtactactatttcttgacagatggatgaggtcaccagttatgcacaccaccttagatggctttttcttgcgtctacgatttggtaaatgggaggaagcattgggtggcactggatatcatgttgccaggataaatggtaaatgactaaacaattgtgcataatatgttgcagaataatgtgttcctttcttttttaaaaaagaaaaaacaattagataaaaggaaaaggaagtgatatgccttctcttacaggagtactggataagaatcgcctttctgtgaccatcaggaattcaacttgccaagtagattctcgctttgtatccaaccatgacttccaccaggtaatgtatcaaaagatagtactgttgtccaagttgttatggaccacggaacaacaataaaaaaaattccaagtcaaatctttttttttcttggagggaattttattgtttataattcaaagtctaagataagtgaatctcatcttttctaggatgagctgaaggcatggtggtcagctgccatgaagagtggctggaaactgccttcgcaagaagaactcaatacgaagctacgagaaagagagctgcttcgtttttgaaacggaaaaggcacagacgccccagctccagatgacagatgccaacatcaattacagaggtttttctcttgcttgcctctggtctgaaaacgccagcgatgcaagcatcatcactaccggtcaggctaattaagttctgcactgtactgctgggattgctatccccacggttgatggtatattgagagagaaatcaggctgccgtttcgtgccgtggcgtaagcagcttgtattgtattttaagtacacgatttgacgatttgatttttacgatcggatgagcagttgcacgagttgttaactacttattgctcatcctatctgctgtaaataggaagctactaacagtcacagtgcagtgcaatcgtacaatttgtactactgctgctgctgagtataaatacttcctgaaagaataaaaaaagttatgctggctgccaatctatgctgtgttgggctgggcacctatggttggaactcatcttggacgtaaatggacgtaaaacgacgcaactcatgttagtatgaattatttaagtatcataacttttaaaatagagtaatacaattttctgaagcaatctttccatatatatatatttttttaaaaatacagtttatcagttcgggaagcataagtgtgaaaaacaaataaatagaagttgggaaataatatattcggactcatggatgatagattgacgggtgaaagtaagtttagaaagtataatactagtattttttaaaaaaaaattaataaatgtttgataaagaaaattttctttaaaaaacggattacattatccaatttaggagctgtttagattttagccaaaataagccttactaaactgtgttaatattaccaaaattttgacaggattttatatgtatttatcaaagtttggtatcaatctaagggcccttttgatttgtaggaaaagtatacgagatttggaggattttaatcctatggaaaatatttctatggaagcttttgaaataattgattgaatcctattctatcctctaaaattcctatgtaataagtaatcctatagagattttggagaaaagttagcaagaggttcaaactcttggaaaaattcatttgagtctatctctttcatccgattactgtgttttttctgtggtccaattaaacggtcattcttgtgtttttcctgtattttctaatcatctgttttacacttatattcctgtcaaaatcctacgtattttctattcctctgtttttctattcttgtgattcaaagggaccctaaatgtaaatatttttttagccactttacttaaaaaaatgacattaatctgaactgtcccttaatagctcgagaagtgtctccacgatgacggggcctcacccttgagaggcggagatcacgcccgataccgtcgaacggcgagcgcggccgcttgcgctttggcatcagagccgcgcgcgtaacgcataaaacggcagattagtcgtctgcccgtgtccgtctcagctcgagaaaaaccatcgaaacctgacgcgatgcagcgctgcgtacgtgctgctgcgacgcgacgcggcgatctttaccttttgcctcgcttctttcccgcacgcgcggctcgcgcatgcatgcacgatgcgtatccccctcccgcaccggtccctaccttagctccctccaccaccgcacacttttggatctccctcccctgctccaccctcctggcctcaaactaacctgcatcttcgtcgacgcgcgacgccctagcttggcgcgcgacggacggatcgatcatcggccgatgcatgcatgggcgcctgtgttctgagccagcatgcggccagctgcatcgtcgtcctcctcctcctctcgcgaccggctgacgatcagccggccgacggagaaggacgacgtcgtagaagagaagagggacggcggcgacgtgacggcggccgtgccgaggctggcggtgtacggcgccggccgcgtgcacgagatcgagcggttctcgcactacgttggtacgtacgtacggtttctctccatcgatcacctaattaatttacgttactttgtttttgtttgaagccaaaccttaaacgtacgttgctcttctcacgttgttagccagctagcgcgtcgcgtcgtttctgaattcttaaattccatgagacgtgtgctccgatagtccgattcttataatgattttcattgggatcagttttacattcgtaagagcaagtttaatagcataactcattactatctccaaatcatatatagaaaatacaatagtcaattcatacaatagcgcttactatactattaatacccgatctcacttgtcatacacacattacgtcttgaagccgtgctgcagctggctacatatctatagcctgctgtttttctctctctttttttatctctttaaaatatgtttatagttgacttatagcctgctattgtacctgctctaacacatgaggcaaagaagcaaagctagtggaaaaaaaaagggggaaacttgaatgcaggtaaagcgactttggagccagtccatggacgcatcctctgtatcggattcgatgcacagagttttgcatctgaacattttggttaagctagctgtagtgtaaaaagttcacatggaccaaaacattttattctcaacacttcacaaatgcaatagaaatgactccggctcgggcgcctgatggagggtttttaaaatcgggagctgatttcagcatgacatcagcgtcacgtatccttgcaaaaccactttaaattgatttttctcttaaattacttacccaaattatgatccgatcgcactattaaattcattacaattaaaatttcaaaacaagaccacacatggatatattccgacgaaaaaatagcttattattgaattatttttaaatgttgcacgatgttccatcaggtatatcggaattgtttcactaagtagatcgaaaatgtttcactcgtttaaatcgggtgttgtttcaccttatataaaaacaatgtttcagcaaatagcgaaagaatgtttcagttcactataacgttagatctatgcatagtgaaacattgtgagtacactaggtgaaacattttttatggaacaaaaaatgaaacgaattcccataatagagggtttccaaaatatgtaggtgatttgttgcaatagagtatttcagttcactgcaacattagatctatatatagtgaaacattgtgagtgcactagatgaaacatttttttggaaaaaaaaataaaccaaattcccttaatagagggtttctaaaatatgtggataattaatttgttacaatggagtatatgttgcaaataagtggcaggtgagagcagagacgtggtgaggctcagggacagagagcgcgcgtcgtggaggagggagcgcccgatatttctccctcccccgagcgaccgatccggggcattccccaaatgcaatagccattttttacgatcatctgtaatagtatatcgtacagttttgtagcgcccgttccgtcgtggcgcctagcgggaaaactatctcttaaaaactctatttgcgaaatctgtttctttgcttgttgtctagtgtccgtgccatctcagatctcaaatccccgatctatcgccgagttcaatcccgaatccaaatccttcccaaatcaattcctccgcaaaagtctattttgcctccccgggttcgatgggccgaatctctctcggcccatctccccctccctccccgggtctctctctctctctctctctctctctctccctcttctccgctctgcccgcccgtcgcgcgcgcgtgcgcgtgagccgcgccgagccgagccctcctgcctcgcgtgcgcgcgcccgcgtggccgctgccctgccgcgcctgcgccgtctgcgccgcccggccccgctgccccgccgcacctggtggccgaccgcctggtcgccgccgccgtcagcctctgccgcgtctgcccgcgcctccgcccgtgtcgtcgccccgctccaaaccgccccgccgtcatcgccgtcgtcatcgcccggcccccgccactccgcgcgcaagctgccaagggacggaggcagagctcctcctcc

SEQ ID NO: 69622 - DNA, 3244 bp, Oryza sativa
tctctccctcttttcccctttttcctcccgccggcgtcatcctcctccctcctccctgtcgccgctttggccgcgaccgccgaacgctagccctctcctttgaccgccctaagtcggttcccaaaccgacattaccatcctataaacccaagcttccccctttcctttcctctcccattcgcctccacgccattgccgccgcctcccgtgctctgttcgccgtcgccgttcgtcgttgcgcgtgtcggaggagccggcacgagcaaggacgcggaaggggactccgagcgcgcccactccttcctcttccccggcccgaggccggagagattactcccgcgccgtcggcctctcgtcactgcgcccgcccgcacggtagtgcatctccccgttctccctcctcgctccatctcctccccttagactcgggtagtagcacgagtagcctccccgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagcagttggctcgtctcccctcgtcctgtgcaaccacccggtgtgctcgctttcgcctgtatcgccgtggttcgctccgccgctcgccgctgtcgtccgccgtccgtttcggccggcgtcgtcgtctacctcccgccggcccgcgtggcagccacgtaggcgccacgtcggcgccagctcggccaaaaccgggtcgagtcgaccccggttagccgctccctccccatgcgcgcggtccaccgcgagccgtgaggctgcgcgtgggcccgccgcatccgcgtctccgcgaaccgcgcgcgtgcaccgcgtctctcccccatcctagcgccgcgccgcgtgctccctccgcacggtgagccgagccgctgacaagcgggtcccactcgggaccacgcgaggtgagcccggtccaccggctctctctctcctcccctcccgcgcgcgcgtgccttgggccgccttgggccggccggcccatttagctcggccgagccgccccttttctctcgggccgcgccctagccgtccgagggaagtgtaatttccctccctcttttcttttcttttcttttctttttcaaaaaggatttaattaaatccttttcctgtagaccaaaaatccaataatattagaaattcaatatcttcccaaccgtaaatccgtttgactccgttcaacttccaaaatccctcaaatcttaagatctatctaatggcatgcttagaggtcattaatagggctttattttcgccgtttgttgagttgtcccgttctgcgcgtagtttcggagcccgaagacccgcagtgcgaggatttcgaggatcaagctcaagatctcgagcaaggcaagccacctttgaacatttcgagcctatatttgaatttaatcatgttgcttgaaaaatattatgcattgataggatcgcacttaatctgtttgtcccgtctgcaaggcagattgtcggacctacctagtttgttgcatttgatccttcctttgttaattgttataccatgttcccttgtaaccacccagttgcgcctcgaaaatcgtgcactctgcacgagtatcgacgatcgccttcaaacttaaaatctgaaaaacttcttgggtaaaacttgggttttacaaaagacttggaaaacccgacacctgggtcggtgcttgcgaactaaatgaattttccaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggtttcctggcacagtatggtctgggacctaatctgttgttggtctgggacccctctcgtcggcatatggtaaacctgtgtcggctttgaaaatgccttgtcatgaaagcttggaggtctcccgacgtggctgatccacacgggctgggtgatccgggttagtaatgtcgtgtgggtaaagtgtaccccctctgcagaggttaacaaactgttcgaacagccgtgcccacggtcatgggcggatgtgaggtgattcctagtgtagttttgtttgactactacttgtgaaattgctgttgtggaaaggggttcgatgtttaaaaaatctgcagctgatgggatcagctaggcccgggtggccatttgaaagttgttggcccgggtggccgtttgaaagttgttggccgggtgccaatcttgatcaattctaaagactgatacatttgcacatactccgaccggacgagacgcactgtctcatccatgttgtttgagaagcactcacttagttgctttcagaaaagagttcaaataaaatcaattgcaaaaacaacagcctttccttgaagcctgcattaaacacttatttcccatggcttgctgagtactcccgtactcacacttgctctatataaataatctcccccccagttgctgaagaagatgaagcggatcccgctgacgagaagttcttccaggagcaagccggctacgatgagttttagggtttcggcctagttcccaagtcgcgcctgtgttgtttggtccaagtcctggcttccgcttcccttttgtaatgcagttgtgagctcgggatctgtccacagcctgacttgattgtactcctactctataataaagagacctctgttgctgtgatattatgtcttcctgtgataccagcactgtttcctgggactggtatcgattaacaggttaatttggagcgtcacgggctagtttcggtcggtactagttcggggcgtgacaagttttcaactgtatgtgttcaggtgttcgattacatcagtgtttttgtcaaagctaattcaccttgctgttcatatctatccatccattataaaagatttgaaaatatttaacaagatataaatatgcgatatatcgct

SEQ ID NO: 69623 - DNA, 14570 bp, Oryza sativa
ctgcacgggtcgagtcgcacaacacctagtatccatcgtttacggctaggactactggggtcctgtccaagccaaagaacttacccccgaaaagtcctgacaaatgatgattgagacgagattccgcgtttttgaaccacgaaaggccaactttcataattaaacgctgtcactgtatggataactcttattgtgaaaagagctatttactctataatagataggtagagccaaagaatgtgaaccctttggaaggctgtgggcgatgagggattcgaacccccgacaccgtggttcgtagccacgtttcgactgtatataaattgcaattaaatttatagaattaaaagttaagagttgacaagatagattaaatataattatatttatggaatcaaaagttaaatagtgttgtacaataagtccaattagcatttccagcaacagcccctagccccctattgtaaagcctctaaaggtctaatgggggttgcccccatcttcagctacaaaccccatttcttaggctccatctctgtgtgtgtgtgttttagtacgcacattatatttatgtctagtttaacaccagaataattcaaacacgtagaattcaaccgtattcaaatttataattttgaataccataattcaaatttaaattcaaaattttcaacattgcaaaatgcataataaaattcaattttcacaatcacacacgtatgcaagttcacaagaattatatgatttttttaaaataacatatactacaaacatgaatggttcaatccggacaaccgactactagcgcgagacattgctagagttgctacgcatgaggtcaacgacctgcgacgtgtcagtgtggagatcacgtaggttgacgaacgacatcggacagggcaacgttggactatcctagcaagatggtgatcagataatagccggcggcacgacaaaagaaaagagggtagcaacacagtgagagcgcgagaacaacgggagaagcgcgcgctagggaattttcacacgcaccaaaaagaaaaagagatggggttgggtgtagagcctctaggattgagggctatggacagagatttcggtgcctttctattttaggggctttaatagcggtcctgccgtcctgctggatctcaatttttctcctttcaccccaaaaactatttaggggtttaattagtttaggggctctgctggagatgctgtctagtccgtgtaaatttgcacggcataatctgctagttgttcattatcctaaatatcaatcaaatgatatattttttttcagctaagcagatagggattgaggatgtgagcgagtgcccccacctttgtgcactagcttacggttatctgaagaagactgagggttatgaacaaaacctactcgcgttcttccataacaaaataaactcggacgctcttctcgtgctgttgattgaggagctagacaaatgtatactcggctacttctccttccattggaaatttgccactgaagtaatcacacaggtaggaaagatttactcatcccgtgttctgcattaccaatcaactgttagtccttgagatactctaaacactgaaatgttggagccacttaatttcttaggttctaacagcagagcagcctagaagaaagctcaaaaccatggtgttagaagccactaggtaaataatcatgctttattaatctggaatattttttgtaagaattaaccaggattgattctattgattttggtacaattatgatcaagaaagaatgaaatctggttcttaattgttttgtttcttccttttttggacaaaaagaaagatgaggtttgagagggtgtcaaggaagctgaaggtgacgaggctgttctccacgctggtggaggaactgaaggtcatcggggtcacctgcaacgacggccagctgcgcgacgccgacgccgacgtgatggtcccggcggctcaccgcgaccgcagcccggtcctgctcctgatgggcggtggcatgggcgccggcaagagcaccgtgctcaagcagatcatgaaggggtcagtccgttcgtccacttcgatcacggactcgagcaggcacgcgtgacgcggcgattgagctgaccaccaccgtggcgtacgtgcaaaatgcaggttgttctggtccggcgcggcggcgcacgccgtggtggtggaggcggacgcgttcaaggagtcggacgtcatctaccaggccatcagctcgcgcggccaccacaacgacatgctgcagacagccgagctggtatacgtaccacgcttgccctgaacctgctcaatcgtcagccggatcggtctgtgtgggtctggatgtgtctgacacgtacggtgtcgcgtgcgcaggtgcaccagtcgtcgatcgacgcggcggcgtcgctgctggtgacggcgctgaacgaggggcgggacgtgatcatggacggcacgctgtcgtgggagccgttcgtgctgcagacgatcgccatggcgcggtccgtgcaccggcagcggtaccggatgggcgtgggctacaaggtcgccgccgacggcaacgccaccgagcagtactgggagcccgtcgagggcgcccccgtgcccagcgggaggaggccctaccgaatcgagctcgtcggcatcatctgcgacgcctacctcgccgtcgtcagggggatcaggtaattaaccaaccaactacaattaacgtgttcacgcgcctgatcgagcctagctgacacgacacgatcgatcgatcgatctacccgtgcgttaggcgagccatcatatcggggcgagccgtgcgggtgagctcgcagctcaagtcgcacaagcggttcgccggctcgttccgcaagtactgcgacctcgtcgacagcgccagcctctacagcaccaacaccatcgccggcgcgaaggtattattcctaacccgttcaccgatcgattccccgtgtgatgataccgtgctgtgtgtttgagacgttgtacgcgtgcgtatatatgtgcgcgtgcagttgatcgggtggaaggacgtggggagcaggctgctggtggacgtggaggagatcgggctgctggacagggtgagcaggatcaacgaggaggccaacggcgtgcacgagctgtacccggacggccacccgacggacggcgccgggtcggtgtgggaggatctggtgtcgtcgccggccagggccgcgatacagcgggagctcagggaggccatcctcgatagcgaggcctgcttcccgtcgccgtaggctgcacagcagcaagaggctatgtaccgatgcagatttgttggttcgttcgttcacgttcgctcacgacacgatcgtactatacgtgtcgtggtgacgtagtaggtaggggtgatctctttgtttttccgtacaccaactctactgtttgatgatggtatcgacgttgactagtcgaccgatgccatccgtcggcgatggacttttcgggaatcgtgacatctgtcacgtgctgatgcgctgatggggccatcttacacaggcagccctcgacgcttagggccatcttccttgaagaggttagaaacgtattaggcctgaaaaggggcccgagtacagcgctgcaagagaaaagaaggtagcagcaacagcatttcggccctgtttcgctatttgaaatgcatgattttttttattttatttttgtgaggattgaaatgcaggattttttttactttggtcaaacattgacatcatactgtatctcacacgttttctttgagtaattgtctatatgattcacatattctagaactgcactatagtaaaaggggtattttttaagagaaacagtaaaggagtaataagaaggtcctttagaaatttatggattgtccactggaggttttcactgatcttttctggaactagccaggttcccttggcttgtaattctgcatccaatgtttttggagagcacgcaaagtagtgttgatctctgtgaaaaccagtttcttttgacatccttaagaggaatgcgacaaatgctaactcaatgttcggttgcaaaaccaaaagaaagcaagaaatggtaagaaaatgttcagttacaacggcctattcagaatgcgagtcttaagggcctcaaacaaaattgctctctatttcacctgaaatacaaaaatggactgtgacctgatgcatgttgcaagcacagttcagaatgtttacatacttacttacctcagacgaaaatatgataccaacaaaatgaattaatcatgaacgtaatatactatgcccaacttagcaagcatcatgtcttgtgcattgcactaccaggtaacctcttaaccataaagaatcaacagaatctgcaggtaccaaagagcaaaaagacaacatgcaattctgaattctgcagagttgagttttcaataggaagttcagagagggataaccaagcttgaccgaaaatttaatcaatccatcatggtaaagaatacaaaagaaatcaagattcaaccattttgggttctgcattcagtttagaacctcaatgttcacgcttcattcagtaacttttcaagagaaccagagaagccctgacagagctacataaccaaatatcagaaaccataaaattccaattcgttcaaggcaaatgtgcacaatcatctatcaattaaaacgttgtgcactcgtcaaagaaaatataagcacaagtgcacaaccatatgcacatgtccacactgaatatcagttgcagcacaggatatagatatactaatgactgaatcatccaattaagtgggaaacacacattagcaaacggtgcactgcaattgtagtacacattgatcatagctgcaatagccaagagatttatactagaaaaaggtgttctgcttctgctaatggttggagactaatcagaaactacaagctcagcactacaatactatccaaacttccaaactcagcaaaaagaaacaaagacaatggagacgaagcacacgtcggggatcacaaacaagcttacccgttgagcaaccaaacttgagaggagtagttcgatgggtcttgctccgggaagcagagctccacctggagtgcaggttttcccgtccatttcccgcagtctctgcaggggtaaagcgccggtgcgccgccgccctgcccgggaatccgatgatcgaagaagtagacgccgccctcgaagccggggtactgatccgtgttgtacgatctggagcagccgcgcccgacgaacagcatcctgccctccagcgagggcagctccctccagatgtatcgaaccacgtcgccgtcggatctggagcagggatccccgacgaacagcatcgtccggccatccagtaagggcgcgtcgccgtcgccgtcgtcgtcttcctcgggctgtgccatccggaacaccttgaacgccgacgtggactctccgggacgaggagagcacctcacgaccatgagcagctctccgctggactccacgaggtagcgcgccacgacgtgctgcccgtcgtagccgcgcccctgcgacgagaagcagcgatactcccattgcacttgaggcggcgcgttcgcttcgtcatcgaagcccggattgcccacgacgatgtgctgcccgttggtgaggaaatggaaggctccattgtggcgcacgacgtccaccgcatcccagcacgcgtcctccatgaagaagcagccgatgaccaccttatcgtcaattcgccagaacgcaatcttctgccggtggtggcccggtacgggagcacaattgttgacgaatccggcgaccacgcatccatccataaatgggtccgacgagagggtggcggcgttgatgaacagcgggtcgcgcgggcgcagccgcttctgcctaggccgcaatacaggctcttcgcggtccaactggatccagacggggagaacgaaggtattcggggtttggtggagattggtgaggaaataatctcgataaccctgagctcgaggatgagcagtggagacgaaggcccagccgccgtcgtacgagccgaagtagcaagcgtggcgaatccactccgggacgaagaaggggtgggtggcgcagtcgctcaggacgcaggagaaggccagctgctcggcgagcggcaggatgagatacggcagcttggggggcgggagcaggggcgggagccgctcgaggtgctcgcgccatggtcggcagacgccggcgaggtgcacgcggttgtacacgcaggggaggcggttggcgatctcgcgcacgacggcgtcggtgaggtccgcccatggcgggaagtcggccatgagagacggagacggtgggggagggaagaggaggggaggttgcggactggggtggagaagaagaagaccagagggatgggaaggtttgattcctcttgtagcttcgggaggagggagctgtgtctgtcttcggagtggattaagggttggtttggtttgttgcctaaataggtcttactaaattttgtcagtgtcaaattttggtaaggtaaagttgtgtttggattgaagccaaaatagcctaagttcactattgaaatgacctatttttttaggcatgtcaaatttggcttcaaaccaaatagacactaaacactattaaaattgtcaaatattgataagcctaatttagacctcaaaccaaaccagccctaaattactttttatactgcaatgaaatgggccggggaagctagggctgtctggacccacccactagggctcgtgtgggcccgtactgcccataattcaagaaacttaacaaacccattcattttcatctcgaatcaaattaaaagagactatgtcgtcatatttttcacagcatgtactgtacctaaattacatgtgtaattctaatgtaagtctcataattatatgtaggtttataaattgcgtatataattttagtgtatttacaacttaaataggagaattactaatactgattaattaacaaataacataaataagggaagagacaaatcagaagagaggagcgagggatatctctgtccatgccggccgtgatatacggatgtgagtcacccacgacgcatgcaaagcgcatcctgcaattcggactatccgactgaaatcgaaccaaaatgtggcgacagaaatttagcgatatctaattaaaaaaatgcatattacacattttctcgattccaataacttatcgaataggcagtctctgcctctctggtcatcaggctgccgtgaggggtaggggcgggcctacttcaattcaagctgaatacccaagatcttttttaagaaaaaaaaatatagtatgtactatgtatatgtgtgtgaagaaaatgaaaaaaaaatgatgtattcagttcatcttcttcactgcttgggcctgcttgccgcctccctgctttcctggcccaactcgatggcctaaacaacccaaaactagctggcagcagtgttcactcaccatcgtagatggccttgcctgcctgtgtcacatcgagtagctcttgaaaattttccaatgccacacgccgcacccctagacgcaactgcgatgcacgatggaggagtggagcacgggacgtcgccacattttctttgagtaatgtctatatgatccacatattctagaactgcactatagtaacaggggtattttttaagagaaacagtaaaggagtaataagaaggtccttaagaatcactgtaattctgcatccaaatgttatggagaacacgcaaaggagtgtcggtctctgtcaaaatcagtttcgtttaacatcctttagaggaatgcaacaaatgctaactcaatgttcggttgcaaaatcaaaagaaagaaagaagtggtaagacaagaacagagcaagaaatgctaagacaatatttgttggaattaatagatgggctttagcccactcaaagattaattctttgagtaatcacaaaagcccaactcataggatagcatgtatggggagtttagtaccaccttacttattctaggagaggaggacctccttaaaagggaggatgccctcctagccacttgaatcatgtgtggtggaaagaagagaggaaacacgcgtgtgcacgacgatgccagcctccttttgcagggagacctatctctatataaactgagccaacgccttcacgcaacacacataaaccagggcgccctgatcatgcacgacgatgtagcctccttttgcggggcgacctatctctatataaaccgatgtagcctccttttgcggggcgacctatctctatataaaccgagccatcgccttcacgcaacacacataaaccagggcgacgatgctagcctccttttgcagggcgacctatctctatataaaccgagccaccgccttcacgccgtcgctcgtacactactccatcctctccggaacctctaccttcgacgtcctgcactaggtttttgggaagcactttgcaccaggtttttaggaaacactttgcgcgactgctccctgttcgtcctgcaccgggaaaggcggcaataaggtttttgggaagcgctttgcgcgactactccctgctcgtccgcgacggctcgtcttcctctccgctcgcgtgctacgaggcggcaataaggtttttgggaagcgctttgcgcaactaccccatgttcgtccgtgactgctcgtcttcctctccgctcgcatgctgtgcggcggcaataaggtttttgggaagcgctttgcgcgactgctctctgttcgtccgcgacggcccatcttcctctccgctcgcgtgctgcgcgccttcgtcgacgcccgcaaccacgagtagttcctgctgagcaaccggtctttccgtaacctcggtacgtgttcgacatgttgcgcatatttgatctgttcatgttttactgcttagtttacacgtgtagatcctataatgcatttatgctagtttacatctgcaatatcatgatttatttatggaataaattaaatcattatgtgcttataatttcaacaatattcagttacaaggtctattcagaatgccataagggcctcaaacaaaattgctcgctatttcaatctgaacaacaaaaatggactgtgacctgatgcatgttgcacgcacagttcagatgagaaattattccggcatcatggttcatgagaatgtttagctactacttacctcggactaaaatacgataccaacaaaatgaacaggttaaacatgagccctaaaacagatgagggtaagataccatgccaacttaattagcaagcattgcgtctgtgtatgacaactttttgagaggtgtcttgtgtattacatatcaggtaacctgctaaccataaagaatcagcaggttccaaagaggaaaaatatagcctgcaattctgcagaattgatttgtcaataggaaatttgactaagccagcagaatctgcaggcaccagagaggcataacaaagcttgactgaaatttgataaatccatcatggtaaagaatacaaaataaatcaagatccaaccattctgggttcttcattcagtttataacctcgatattcatacttcattcagtggcttttcaagaaaagccctgacagagctacataaccaaatatcagaatccatagaaatccaattcgtgcaaggcaaaggtacaacaccatctatcagtcaaaacgatgtgcacttcacaaagaaaatataagcacaaccatacgcacatgtccgcactgaaaatcagttgcaacaggaatatactaatgattgaatcatgcaattaagtgggaagcagaaattatcaaacggtgtattgatcatagctgcaatagcaaagagatttctactagaaaaaggtgttctgcttcttctaacagttggagactgatcagaaactacaatctcagcactacaataccatccaaacttccaaactcagcaaaaagaaacaaagacaatgcagacgaagcacctgttagacagatcaaaaactagcttacccgttgagcaaccaaacttgagaggtgtagttcgatgggtcttgctccgggaagaagcggtccacctggagtgcaggttttcccgtccatttcccgcagtcgctgcaggggtactgcgccggcgcgtcgccgagctgcccggcgatccgatgatcgaagaagtagatgccgccctcgaagccagggtactgatccgcgtcgtaggatctggagcagccgcgcccgacgaacagcatccggccttccagcgagggcagctccctccagatgtaccgaaccacatcgccgtcagatctggagcagggacgcccgacgaacagcatcgtccggccatccagtgagggtgcgtcgtcgtcttcctcgggttgtgccattcggaacaccttgaacgctgacgtgaactctccaggacgaggagagcacctcacgaccatgagcagttctccgctggactccacgaggtagcgcgccacgacgtgctgcccgtcgtagccgcgcccctgcgacgagaagcagcgatactcccattgcacttggggcggcgcacccgcttcagcgaagaccggattgcccacgatgatgtcctcccccttggtgaggaaatggaaggctccattgtggcgcacgacgtccaccgcatcccagcacgcttcacccatgtagaagtagccgacgaccaccctatcttcaatttgccagaacgcaatcttctggcggcggtagccgggtatgggagcttgatcgttgatgagtccggcgaccacgcatccatccataaatgggtccgacgagagggtggcggtgtagatgaccaaccgatgcagcagcggcttctcctcaggcgccaattcaagcgcttcgcgttccaactggatcctgttggggagattgaaggtgcccgaggtgccggccagattggcgaggaagtacactcgattagcttgaggatgaagagtggagaggaaggcccagccgccgtcgtacgagccgaagtagcaagcgtggcgaatccgctccgggacgaagaaggggtgggtggcgccgccgctcaggacgcaggagaaggccggctgctcggcgagcggcaggatgagatacggcagcttgggaggcgggtgcaggggcgggagccgctcgagggactcgcgccatggtcggcagacgccggcgaggtgcacgcggtcgtacacgcaggggaggcggttggcgatctcgcgcacgacggcgtcggcgaggtccgcccatggcgggaaatcggccatgagagacggtgggggaggggagaggaggggaggttgagaagaagacccttgtgctggtttgattcctcttggcttctggaagcttcggaaggagggagctgcgtcttacggagtggagtactttttatactgcaaggaaatgggacggggaaggtagggccgtctgggcccacccactagggctcgtgtgggcccatattgccgataattcaaaaaacaaagaccatttttcatctcaaatcaaattacaacgattatacatttgctcgattcctataactaatccaataataattcaagaaacatatggctcatccgaagttaagaacatcctacgtttatgcgagtgattatgacaacttatggcattgactacagggctccacaacggtcaacttaactctagcgggaactttatcctcgatgtatcttccgatagccacaagcgctgtacgggcttccctcaaaatactatgcgcatggttctgcaccgttcaaatctttcgtcagaacacctaaaatcatacggatacagggtgtccaaagtaagacactcgagcgacaccgagttcttgaggatataacaagttagctcaaccaagctcttagcagagctaaaccctgtgatctccacattcttgaggtggcaatggtggtcttcagccatctgcctcaaatgtgactttgaggaatgtcctagaattgattcatgcttcataggatcatttgttacctgaagatgaaaacaaagtatagtcaattgacctgacacagtgaccagataactttgcaggataggatgaacagagctttacatccaagttcaaagtctccaaggaaggagacgcatcaaggaaagaaaccagagaaaaatagtcataggacggcgaaaaggttccggagctcaaacaaatggtcaggtgcttgaggtagaggaatttggtaggcagcattggtgtattaaccacctgcgcaaccaatatgccacgtctcagatcaattattcaaaagccatgtgatacacatacattgctaatcgacaacacaaagttttagagtatacctcatcataggagcttaaggcaagagtatcaatatttggcatactggatggaagctcagaacgagcataacagacaacatttggatggcgcatgcttaagttcttcatttgcaatgtttccccaagcaacagttccgcctttccgctaaggtctaaagtggagagatttggaactttgctctctatcaatttcagcctcacgcatccatgaaccctcaggcagctgaaccgctgcagcacacaaggtatccttaggcaaattatatgatcgcagtgaatgagtgccaactgctctaaagcaagagagtttgaaagaaggcactctaactcatcccctgtaatacgcacgtattgcagatgcaactttgttagtcttctgaaggggccaagttcagttgcgggacggaagatacaaaagccaagttcaagataccggattgagttccgaaccccatcagataaaagtgcgcagggaaagttgtacgttatctccagtctacataccataagggtgagttcttcaatgcctggtgtaacagcaacttgaagccaattgtcaagattgtgatatgcggtaccagataattcaagcttcaatgtcttcacaccaatgcctgagtggtttcccagaatagagtcaattctgtggctgatatcccctccatacgtaaatgctttgggtctaaacacatacttattgaaggtgaggttgggatagcacctccaggaacatagaaaggaatgagacaggcaagcagtgcgagcagcatcacgcattggcattagggaatgtatatgacgccagatatcctgcatggacaaacataggaagagaggttcaaatttgggattgtaaagccaaatggttacttaaaccagataaagaagaacagtgcgacgacatggagtactagctctccacatgatgcatgcaaggtgcgctgccttgcttaggtacatagtgcagtggaatgtaaccttcgtaggtaaattgagccttgcatagaaaagtttatcactaacagtgttatcacttatcagtgattctctgaaagaaaagacagttactggtgggtagcagtgattaactactatgaaatatactcaattggcattagagcactgagtagacaactatattagttgctgtgcaattgtgtcaaacaaaaatgcacggagatgatgttttattgtgcaacagaaaaaaaatgcaatttctgcatagggtagtacacctgagagcctaaccaaactggagcccaataaatagaaactagcagttttgagttttgacagttacagagtaagatagacataaacctcattaaatacatgaaagagataatagatcagaaaggaccatacacatcatgaaattcgctattcaacccatcagatagcatcatagcaatatggtaaaatcaatgccccatagtgaattgtgaagccagtgacaatattgatcagttctcctttccattttttttatagaaaatgaaaatgtcaatcaatgtccccaggaaattggtgacagcacaacattttcaccagggtatgacaaaagcatcccgcttatgttaatctaccaacagtggactttttttttccgattcttctggaatgaacacacatacctgacatggttaggtgtgctaatacttggcatacctgcttgtatttggagatcacaagttacagttgctagacttttgaggggaaataggacttaatgatgcttgccaggccttctggccattggccaatctaaaacacaaccatctcataagtttaccttcttgggaagctaaagacaatgttcaatgttataaaagtgcaccagtacatagggggctgatgatgatttaacaaactcttggtgtaaagacatgcttaatatgtatctatggggtaagggtgattgagatctcaatatgcttaagaataaacactggagtatattactgtttttaatccggaggattaaagattccagtgaagctgctactgtaactgttctctgcaaaggttggtaataccagtcgcatatctccagaatttgtgagatggacagctcacaaggtgggaaatcttatattaagagtttgcttaacagtaaaattatatatctttattacacatttaggggaaaccgtattactcaacagtcatatgcttcattattagtgaatacacactcaag

SEQ ID NO: 69624 - DNA, 10644 bp, Oryza sativa
ctgcagccctaatttaagagaaattaagataactcttgggagtctactcatcaagataacatgtgacctaagactcatggcagacaggaaagctaccaagttaggagcgtaggggctgtagcctttagcaattggagatccgttccctgcttacagatattatttagctagcatagtccaaagaacttgtttgttaaaggccattatggtgaaaatgtgcttgcaacataagccccccatcttcaaaatttatgtggcatacctctggaaggtctgggattgagcaacccttttgtttattcgctgaagcagccgattcatctgcaacccaacaaggtaacaaccatggttatgacagcccaatcccagacatgaatatattttcttaagataatggataagaattcggcctctatatctgaacatgaaccccagacatgaatagatgaaaggaaaaaaaaaaagaaacgaactcagcaaaggcaatgacatcttgaatctcctcccaatctctcttttttgttcaaggaatcaacgtatttgttcccacatgaaatttctcattgcttactcatgtgaaagagaaaattttggttcaacagggggaagcaacgacactagctaattacctctacagctctactgtgaacaagcgtctagtttttttttttagataataagcgcctagttagcaaaacaaaattatttttttctttaaagaaagagctgcatatatgaggttaaaaatactagtagaacacaagaagatgatttccggaacatatgcacgtaacagaagagagggtgctaagaggagttggtaagaggagaggagaggaggcttactccgggcaaggattttccggcgacgccgctgctggttacgctggatggacaagagccgctgcaaccccatggtaggagtagacgacgcttcttccttcttcatatcactgctcctcttccacctttatctatctgcagccttcccttcttcaagtgcgcctcgcggcgggatagcacgcgggcaatcgggttgggggtgcgcggggaggagatgagggggagccgtgcccgtgacgaggtgggatggagggaggcgcgcggcgacggtgaggtaacgccgccgagcagtgttgatggcacgatagtctaatcggaggatgccgatttgatgagcataggaactgttagccctctctgtatttgatttggtttggaactcaattcagactacagtacgattactagaccagtcttgggaaatttaactatttgtcacttttacgtttcacaattaaccaaataccctccccttcgttttgtttaccagccacaaggtagaggatacgcctccgctacagccgcgcacgacaacaagacatggaaaacaagttattatatgatctctgaaccctgtgaaaatcagtttattttagcatccatccatcataggattgcaacaaattaatgctagctcaatgctcagttgcaatactgaaagaaataaagatatgctaaggcgttgttcagttataacatataacaacagagcaagaagtgctaagacacacaattgctaggaaatgtcggcaccaactacaattccttgatttggaaatcttggtcacctgcgaaatgcaaattttatgcgtggcttatgatacaaatagagtttggacatccgaccggctaactgcaagagaatggcaaaacaatggattgtgccccttatgtcgggagacgaacgagacggtatgtcacctggtcgcctcttgtagatacaccatgagtatttggaggctaacggccagctgagttgcctatcagcaattggatctgaaccattgggacccatgccaaagcgttcaagagtggtgggacatgctaaacaacaaaaaggaagtgcccaagaaagaactgtgatccttgaccctactcattgtgtgggaaatttggaaggaaatgaatcaacggatcttcaagcacaaggaaacaacggctcccaatcttatggcgaaaataaaggaagagacaagaacctggatcatggcaggtgcaaggcggcttggagaattcctcccttcgtagcaatagcctctttgtttttgtgtacagtttcccttttatccataggggctgtattttttttacctctatatccaatgaaatagcacaatctcgtgctgattctttaaaaaaaataaaagaagaagtgctaagacaatgttcagttccaacttacaatggtctattcaggatattaactgtgtgggggtgatgcatgttgcttgcactaattcagaaaaaaatatggtactgccagcaaaatgaacatgatcaggatattagcaggtaacctgctaacagtaaaaaatcagaagaatctgcaggcaccaaatagagaaaacaatctgcaatttctgcagaattgagttctgcataggaagtttagaatggtataaccaaaacttggtaaaaaaaatgtgggcaattaatggcaaagaatataaaataaatcaacattcagacaatttgaaggctgcattcagcacagaacctcaatgttcagactttcttcaggaacttctcagaaacccctttatatactgatagaattgcataaccaaacatcgaattccatgaaaatataatccacttaacgcaaagaaagaaatacaccgccatctgtctatcagtaaaggtgtgctcccgtctaagcaaaatgtaagcacacagtcataagcacatctccacactgaatatcagtggcaacacaaggatagatatgacgggttatcaagtatcaactatttccaagtcttgaatcatccaaaatggaaacagaaatgtagcaaacgatgcacttggatcgaggtacacattgatcatatcagcaagagatttgtactagaacaggagttctgccttctgctaattaacagctaatatctcagcactacaataccatcacactcaccaaaacagcaaagagggggaaacaaacacaatgcagaggaagcacacgttagctaagatcataaactaacttgacctgctgatcgaccaatgttcccaaacgaaacggccaaaccttgctgtgtggtccgccgactcaactctcaagggagacaccaaccttggggggtgtagcctatcgccgggaagcagcgctccaccatggaggcaggtgttctcgtccatttctcacagtcgttgaaggagaatagcgtcgcgacgcccagcggcagcatcgccggatcctggatgtcatcatcgaagaagtagacgccgccctcgaagccagggtactgatccgcgtcgtaggatctggagcagccgcgcccgacgaacagcatccggccttccagcgagggcagctccagccagacgtagtgctgatacgggaacacgtcgtccggcccggcttgcgccatccggaacaccctgaactccgacgtcggctgtccaggataaggggagcacctcaccaccatgagcaggtcttcgcgggactccacgaggtagcgcgcctcgacgtactgatcgtattctcgcccaatgtgttcgaaggcgcgcatctcccagtcgaccggatccccaccatggaagtccggacctgccacgatgatgtgctccccttgggtgaggaaatggaaggctccatcgtagaacacgacgtcctccacatcccatggtggattatgtgtctggaacaagtgagggatcacccgatcggaggcgcgccagaacccaatcgtccgctggccccgggggacggggtcaacgctgatgatgccggcgaagacgcatccgtcgacgtctggttgggacgagagggtggcggcgacgatggagaacggcaactgccattcctgcccgggcgctccgtcctgctgcgcgatgaactcggtggggaggtcgatgtgagggcgggagtcttaggtgtcgaggaggcggtgctctcgaggacctcgaggtggagcaatggagaggatgaccagccatcgtcgtacgcgccgatgtagcgtgcgtcgtgcggccactccgggaggacggcggggtggatggcgcagttgctcaggacgaaggagacggcaggccgctcagcaagcggtaggatgagaaccggaagagcgggaggcaggggcacgggcgcttgctgctcgagggacgcgcgccatgatcggcagacggcggcgaagtgcacgcggtcgaactcgcacgggaggtggttggcgatctcgcccacgacggcgctgacgaggttcgcccatggcggagaggcagccatgggagacgggaggggaaggggaggttggggtggacttggtggcaaattgcacgggacgctcaccgctgcggtgtctgttacaagtttgattcccttttgcttctggaagccacggaacggaaggaggaggagggagggcttcttatactgcaaggaagagagatggggggattgggggatggctcgtttggcccactcgagcatgttgatcaggatgggcttgtgccccaagaaagaggaggaaggctcgcttggcacctgagcacattgttcgttcctgatgggcttgttgcggaccatttcatggcctgatttgattaaacatgataaatggacatgaaggtaaaacaacccaaatatgaagccgattctaaacacagagtatatccaaatcaaaacgagtttttttttttggaaaagttagatttgttttttatttgtgtaattttatcgttttgaacaatggtgaagtcaaactataaaatatttgactatgaatcatttaaaaatatttctcttataaatatgaagaccatatgtgcatattagtcttaaaaaaatacttcaataaaattatatatttgttcatatttgtatgtatattataatagaaaatagtggttaaagttgcttgatcgtgcccttataaaaaacaagtattatcaatccagagaaagtactacataaagcatttcctatgtcccaaaatataaacatttatagttatgaatctaaactaatgtgtgtctatatttataactaaaagttgatatgttttgggaggtagtaatatattgctttgtaactactggatttatttatttaataagaaaagctgcattcttaatgcagttctttctacgtactaattaatactctcgccggattataatatatgcggcattggcattttaagatatttttaatcattcttatttaaaaacttttatatagttaataattattttttatctgatttatcgttaaatattctttaagtacaatgatttgtattcttttatgattgcgctctacacaattagtagttctccacaaattttaaataaaaacaaatgatcaaatgtatattaaaaagttaatgatgagttcatcacaacaataaactagataatccacgagaataatttgatgaacaatatatttctcggtctcgcgtaatcgtgttcgtttacatatatacaactcgtcccacctcgcgaacagcacggggacaaaaacacgcaagcaacggcttttccagaccaaaccactgcacgtacgttaggtgacatggcgtccatcggcccattgctctaccggcgtgcgtacgtacgtcaacgtgtggcatggcatctcgctaatatttgagagcactcacagcaaaactcgccgaatccctgagaccctgactcccctgttgcggccgtcgcgcgtgcgcggtgcgccggacaggaggctagggggtaccggcaccaggcaggcaggcaagtacgcccgtgggacgagcagggagctagccgggtaggaagggcgcgcggcgatggagtcggggccgcgagcgccagtcgtatccctacgactacgtgctgacacagcttgccgccgtgccgaggcctggctctggctgatttccgtcgctcgtgctcgcgctgatgctgtcgctcatatgccattatttctacaggcaggcaagaccggaacaccaggcagtagctactcattgtgctgctagcggcgacgcaggagttcgacgacggcgccaacacggggctggcgggtcgcgtgctggcgcagtgcgcggcgggccgcgcgccggcggactgcgtgcagtgcctgcaggactcggcgcgagcgatgccgagatgctgctggaacacacgagggctgggagagagcgtcgccgtcgtgctgagcgacgactgcgtgctccagttcaccatgcacctggcctatctccggcggcaagccttggtggagctctccgtccgtttgtcctcggtgccgttggagcagcagcgctagcaattatcccatcacaaaactttacaccctataatgtttgaacaccctgtcacatggagtattaaatataggttaaaaaataactaattgaatagattgcgactaatttgctagacgaatctttttaaacctaattgctttatgattggacaatgtggtgttacagtaaatatttgctaatgacagattaattaggtttaataaattcgtctcgcggtttactaacagattttgtaattagttttttattagtgcccgaacaccccatacgataccctatataatttccgatgtgacatgccaaaactttacacccctggatttatacacccccgtagtaatagtaatcacgttcgaatcgagtgaattgaagacaatttgtagtaatataactgtgggatacacggtacacaccgggtacccaaggagaggcctttgggccgtacgacatagggtgggcaaagagccgtaggcacatgcggcatacttgtaaataaagaaagagaaatttccagaataagatataaatctgggggatcatacatatctttatagatagaatagggagatctagttacaatcaactagatactttacttgtaacccccctcatcctatataagagggggcaggggtcccgagagggggaggtcggattatctccacaacctaggcatacatcatctccactccataccggacatagatccgatacacatacaactggattagggtattacctcacatcaagacagttggatcatcgagacaactggatttgggtattacctcacatcaagacagttggatcatcgagacaactggatttgggtattacctcacatcgagacaactggattagggtattacctcacatcgagacaactggattagggtattacctcacatcgaggacctgaaccaatataaagctttcatcgagtcatggtgctcgatcgagtagtagaaataaatcgtcatatgtagtagggattatgtgttaggataacagtagcttatcatgtgtgttttgtttgcaaaatgctatgcccagctagccgctagcgttacgagcgtccaccgccaacccattctgcagggtgaaagattggacccctttgtgcggcccatggggcggtgaacagaatcaccccgcacgacgcacacgcgttcgccgcgcgcgcgcgcgactacgcgaccgtgaccgcgacgcgggcatatttgaaaaaaaaaagaatttgtgaataaaacttttatatacgtgtttttaccgatctaaaagtaaagactaaaaaataaatttcgataaaaaaacccctcaaaattaactttaaatctaagatagaaaatttaagttttggctgataagtataagtataagtgaaaagataaggcttttgagggccagtcgtggtatcggggcaaggcggggatgtgccggactgccggtgcgccaccatacactgtgaaactaaaagaaaatctcacaattcacaactatacgttatgaaatagcctgcggctaactcacaccgtttagtagtttaggaagcgtgcgcgcggaaatcgaaacaaactcactcacaatcagccaggaaagaacacagccttaagtttccaatatttttgatattttttttcagcctcatcgttatcgttcccgttttcaagaaatatatgattatttaaacggctgatgttgttttccaaccgtttcatccctagccatggctagcaatgcttggtacgtgaaggtgcagtagttaatgacccatgggaaaaggtttttgaatggccaaacatgatgattggtgttatattaataaaagaagtttatgtacatagcaagaggtggaagaaaaggaaaaaaaatgtacattacttactgcaaattacatgtcagtccatcttaggctgtgttttttttaggggttaattaagaaccccttccctacccacagaaaacggaatgatagattaacatataattaattaagtattagtctataaaacttgaaaaataaattaatatgattttttaaaacaactttactatataaactttttgtaaaacatataccgtttaacagtttaaaaattgtgcacgcaaaaaatgaaaaagatgggttgagaatcataggaaagaacacagccttactgacttactcctcatggcaataatctcgcaacgtgttttgtgccagccaagctccagcgacccaactcatgaacccatgagaaatggttactaaactggtagcacacaccatagtccgtaggacttaattgcaccggagtttcgtgccgaacagacctgccaggaatgacaacgcttaagaccgtaagctcacgaaaatagaagagcatagcgcttaataagcgagtaaagggagagaagtccagccaattcgagcaacgggtgaactagctagggaaacaactttcggctgagtaagttcggagtgacgccctcttgattagcgaattcggcggagcttttcgccgcaattacccgttggccattcacagtgcttacttgcagctactgcaatgacgcgtgctaacctcccgtgccatttcgagtagtggagcgtgcgcgtgtccgcggttatagctgcacagtgtggtggcatttgagctcactcgatcgcctacataaagagcggtatagcttcgagctacggcatgcaattcgtctccagcgccctggcgacctagctagctccctcctccgccattgccacagaacacaccttggtgtcgtgcaatccatcgctcatggcgctcaccaagctttcctgcctcctcgtcgtcgttttcctcgccggcgtgacgtcgacggccaccggagccaggtacttcccacagaacggcacggcgttccgcgagaacatcctcgtgctgcccaccgacctccccgcccaggccgctgcgacgaggttcgcctccacgcaggccggcgacggcgacgaccgcgcgctcgctctcagcgtctgcctcggcgactctgcgccggcgcagtaccgcgagagcctcgccgccgcagtcgcggacgtcgtcgcaggctgcggcgccgccagccgccgcgccggcgcctggctcgacgggtgctactgctacctcgccgccgacaccaacatgacgacgtcgcccagcggggggagttccaccggtggctcgtcaccggagacgtcctgccgttcagcgacaacctgtacgcgacgttcctcgacatgagcaacggcgtggcggcgcggatgctggcgacgacggcgacgcaggcgatcgacgtcggagcagccacgacgacggggctggcggggcgcgtggtggcgcagtgcgccgcgggcgtcgcgccggcggactgcgtgcagtgcctggagggcgcggcgcgagagatgccgagatgcttccgggaggcacgtcgggaggagcagggagagggcgtcggcatcgtggtgagcgacgactgcgtcctgcgtttcgacatgacttcttcgccggcgcctcggacgtcaaacacctgtgatgggacttgcaagctgttagccttcgccttcggagcagcactagaatgatcgtgtcagtcactttaatttgtgctccctccgtcccaaaataagtgcagttttagcactgttcatgttcaacgtttgatcgttcgtcttatttgaaaaacaattataattagtatttttattgttgttatatgataatacatgaatagtatttatgtgtgactaatatttttaatttttttcataaaattttcaaatacgaatggttaaaatactggacacgaatatctatggttacacttattttgggacggaggaggtagtagtagtaaccatcgctagctagcttgatggaatcatggtgcttgagtggtagaaataatataatgtctgtctggggggtagaatggttgcctatatgttagcaacttagtagtactaccatgtttctagtgctttcggtgacactattctagccggttgtgtgtttctctttgtgatttgcaatgctatgctcagctagctgaatatatatgccaaattgtcaccttgggaactaaatagagctatgtgatccattgtattgctgggaaaaatatatggtgcaaaccatatatataatataaacatagaaattactgaaattactataggatcggaaaataaacatatgagatttgtctatgtcataccaaaataaaaatttactcctgattaaatcttgagataatcccttatataccattgaaaatcggctcttcccttatatgccattggtttaaatttgcgcaccctctcatgccactccca

SEQ ID NO: 69625 - DNA, 6646 bp, Oryza sativa
  unsure (1)..(6646): unsure at all n locations
ggtataggacatgccttacaactcagaagggcaaatatgtattttttattttagacttaacggtcaacacacagtcaactgacggtagtggcatgagagggtgcgcaatttanagctaatgacatataagggaagagccaattttcagtggcatataagggatcaaatcaattttcagtgacatataaggaattctctcttaaatcttaggagtaaaaattttacttaaagtgtcgtggataaatctcagacgctcaatctttttgtgctacggtagtttttaggtttgccgtgaagccgtggacgcaggtggggggagacggtagcggaagcatcaatctttttcctacctcaatgcaaattataactatgatgagtagtaatattttatatttatattttttttaaggcacataatgaaaaacctccgatttattatttaatcaacaccaactgcaagtctgcaacagccgtgaacgacagcaagacagggaaaacaagttattgtgtgatcactgaaccctgtgaaaatcattttattttagcatccatccatcataggagtgcaacaaattaacgctaagttccatgctcagttgcagtactgaaataatgaatgaaagaaagaaagaaagaaagaaggaagggatgccaagacatcgttcagttataagataagaacagagcaagaattactaagacactgttcagttacatttcaggccataagtttctcagaccaaactgctctttatttcatctgaacaataaaaatggactgtgtggagtgatgcatgtggcttgcactagttaagacaaatttgtggtgccatcaaccgaatcccaagatagaagaaagtaaagtatcatattagcaagtaacctgttaaccataaagaatcagaggaatctgcagtcaccaaagaaagaaaataacctgcaatttctgcaaaattgagagctctgcataggaaatttagagcggcataaccaaacttggtaagaaaaaaaaaacaagaagtgcaaattcatggaaaataatagaaataaatcaacattcagacaattcgtaggctgcattcagcacagaacctcaacgttcaaactttcttcgggaaattatcaggaagccccgacagaaattgaataaccaaacatcaagttccatgaagataatccacgaaacgcaaggcaaacatacggccccatcgatctatcaataaaggtatgcttccatcaaacaaaatgtaagcgcacagtcatgcacatcaatccccacattatatatcagttgcaacacagggatcaataaactacttcaagtctcgaatcatccaaagggaaacagaaaggtatcaaatggtgtaacttggattgatattatctcagcactacaataccacacacagcaagagggggaaacgaacacaatgcagaggaagcacatgttagctaagatcacaaaataacttcctcttttgatagagcaatgtttccgaaccttgccgtcttctccgtctcaactctcaagggagacgccaaccttggggggagtagttcgatgcgccttgtgccgggaagcagcgctccaccatggggccaggtgattccgtccatttcccgcagtcgctgcagctgtactgcggttgctgcagcatcaccgggtcctggatgaacccatcatcgaagaagtagatgccgcccgcgatgccggcggggtagtgatccgcctcgtaggatctagagcagccacgcccgacgaacagcatccggccacccagtgagggcaccctctgccaaatgtactgccgacaccgagcccgctggcttggcaccatccggaacaccttgaacgccgacgtcggctgtccaggatgaggggagcacctcacgaccatgagcaggtcttcgcgggacttcactaggtagcgcgccttgacgtgctgctggttgtagccgcgcctgttcgatgggaagcagcgaaactcccagtcgacttgaggcatagccgggaccggacaccaatagtggaactccggtttggccacaatgatgtgctccccttgggtgaggaaatggaaggctccatggtggtgcacgacgtccaccgcatcccattccctgcgcgggttcagtgggccgctgaacaagccagggaccaccggatcgaagatgcgccagaacgcaatcattggccggccttgtgggacgggaccgacgttgatgattccggcgaagacgcatcgtccgtcgacgtctggatagaatgagagggcggcggcgacgatggacaacggcaacagcgctccggtgtggtgctcgatgtgttggagttaatttatttctagaacataccagcctactctctaaccctctctactactcgtgaaactaaagtcaaggttgaagtccttgctctgtaaattttctagaacagtgtagtgtgtagacatgcatgatgtgattttacagtagtactagtaccagtgaagtttgacaatgtagtagtactacaagtctctagctaggtcctgaagcttcctacatgtcggtttatcaagcctataaatagaaagccagtgcatgtgtatagactgatgatggtgtgctgcccaacgtacaagcaagtgtactgttcagccctcaagcaagcaagtaaagaaaccagttaaaactagcacaagcttctctgctcctcttctctgatcccctgcttaggaaatatttagcaccaacacgatgaacgcgtcggggaggttgatgtgacgatcgaattggtaggtatcgaggaggaggtggtgttggggaccttgaggtggagcagtggagaggaagacccagccatcgtcgtacgcgccgatgtagcgagcgtaccgcacccaatccgggacgacggctgggtgggtggcgtagtcgctcaggatgcaggagacggcaggcccctcagcgagcggtaggatgagaaacggcagagcgggagaccggggcaggggagcgagctgctcgagggactcgcgccatgatcggcagacggcggcgaagtgcacgcgatcgaacttgcacgggaggcgggtggcgatctcgcgcacgagggcgccgatgaggttcgcccatggcggagaggcagccatgggagacgggaggggaggggaggggaagggaaggggaggttggcgactgggtggcgaatggcacgagatgctcacgcgacggtgtctgttacaagtttgattcccttttttttttgcttctggaagccacggaacggaaggggagggtgttaatactgcaaggaagagaggatggggaggagcactgctccctccgtcccataatattacaacctaagattgaatgagatgtttcatagtacaataaatctgaacatgcatctgtccaaattcacatctatctagattcgttgtaccatgaaacgtaccatccagtcctaggttttaatattattggacagagggagtatacttcaagcaagggaggatggcggatggctcgtttggcccacttgaacatattgttcatgatgggcttgtgccgcaagaaagataaggaaagttcgcttggcacttgagcccattgttcacttgttctcgatgggtttgtagcggcccattcggttgggcctattagattattggatctaagttcattttgactccctcaaatatagctccaatctgattcgtgtcccccaaccgtaatatcagatatctagacacccccccctcaaactattaaaacccatacaatttgactccctcaatagttttagagtgtatttttgctgacatggcatattgacttagtccactatgttgacgtgtcagcccagtcacaaaaatacaggtgaagcccacatgtaagtgactaggaaaaatatataaaaagtgggacccacttttcatccctcttctccttctctatcttttccccaacaagcagcagagcaagaagcggtggcagtggtggtgtgggcagaggcaacagaaacagtagtgacgttcctgtgggtgctatgcgtgtcgacactgcgggcctcaatagcggtagtcacctcctacctcaacatctaggaagggatccactacgctctctttgtcaccgtttgccacctcttcgtgctcctcttcgcctttaacttcctttgtgacgtcctcaacggcgccagcttcaaccttaccgccatcgccaccttccacgccaccaacctcgattggcacttgggcagggtgcaagggcagtgggtggagcgctggcaatctcagagctgatgccaacgcagtacaagcacatactcgagggccatcctcaaggtggatctccacactggtggtgccgttgagttggtgctcaccgcaatcgagctcgtccatggcgtcgccgcgacggtggggagaggaagggccgccgctggatcgaactgcaagagccaccaaaagcagccccaccgtattctccaccgccgctctgcatccccgctcgaccaaccactccgcgacaaacgctagggcgaaaggggccagggtggagagagaggagagccctacttgtcgtcccgccgctgccgcttcccatcgtcatcctggcgccctgctactatcgagcctagaagaagataggcagagagggaaggagagagagattagtacatagagggtgatttgatgataggtgggccccaccttttttaaaaaaatatttgatgactagggtgccacgtgaatgccacgtcagcacaaaggagtaaaattgcaacggttttgataatttgggggttgagatatccagtattgtggtttagggatacaaatcggattcggccaatagttaagagagttaagtggacttattcctagattgtacctagactaggcgtatgatgactgtacaagaagagctaaaacaactccaagtatgaagcccattctaaatttagaaagaactatctaaatcaaaacgaggtataatagcttttggttggaaaaaagacagacgagaaaatagcttttttttctctgtgtaattgtgtgttgctaaatagttatatagttacgtaaaagtattatattattctttataagtaatgaatttatttatttaataagaaattttaattatgttcttttaagtttagccatgtttacgatattcttttttaagataccgaaaggtgttcttcaaaaatttgattattatagatcacgtttcttttggcaagggaatgatcataagaaaaagtacaaactcattagatgggatatcatttgccaacccaaagaccagggaggattagggattcacaatctggaaattcaaaataaatgtgttttgagtaagtggttgtttataaattaataaatgaagaaggtgtttggcaagaattattgaagaggaagtatctttataataagtctataatgcaagttgataggaaataaggcgactctcatttttggtcaggtctcatgaaggtcaaaagtgatttcttaaatatggtttcctgaaatgtgaataatggggagcaagtaagattttgggaagataaatggctaggaaatttggcctttaaggataaatattcatctctatatgctattgtccgaaggaaaacctcttctattgctaatgtcatgggagctgttccgcttaatgtttcatttaggagagccttagttgggcagaaccttgcatatgggcatgaattgtgtgcttctaatgtgcatatccagttgaaccattcttctaactgttttagatggaattatcatcagaatggtcggttttctgttaggtcaatgtatctagctttaattaataatggttacatcgagaggaataagtgtatttggaagcttaagatgccacttaagattaagattaagatctttatgtggtacttgcttaaagatgttgtgttaactaaggacaatttggcaagacggaattggaatagtagtttaagatgtttgtatgaaaaatgagactattcaacatctttttatggactgtcattatgcaaagtttatatgaagagcagttcagttctcattttgttttaaccttcttactaacatatctcatatgtttgatgcttggctaatgggggttgacaagaaaatgagtaaactgatacttgtaggagcatctgtcatatgttgagctctgtggttgagtaggaatgatatggtttttgacaaatcaccatctatttcttataagcagataattttcagagcaacacattggctttggttttgggcacaattacaaaagtgtgaagcagatgaagagcatctgaaagttgcgtgtcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69626 - DNA, 1072 bp, Oryza sativa
ttctgtctaaaaataggtcaaataatggtggaaactgggaagacaaggaaataagtttgacataggatgcaaactaaagagatttgaactaaactaaattaattccatatcagtgaaacaagaaatactaacattcattttgggggccagaaactcaatattattaactgtatagtccagaaactgaatgaataaatcatatgaaaaatacctaccttagtgcggctctgggaacatttgtcatcctttggagacacaggctgacaaggcaagggttctaaagctgccctctcaagcaaagctatgacatcaccagccaaaacaaacatgtccacatcaacatggaccataggcactggcagctctacaaaatccactgagtctattatgcctttcttgctcttgctcttgctctggcactcgagcgccttcaaccccgtatacagagagtccataactaacgttgaagttacttctttctccacaaagaaatgtttcactattattttcagtatgacatcactcttctctgtcgacatgcgatgccttgtgctttggtcaattgcaagccagaaggcacggaaactgcagtacaaacaaagatatgcatgtgttagtattaacttttttaaaaacacacacacgcgagcgcgcacagatacttaatcattatgaaaggataacaggatgttgataactttaattgtataacctggaccatctcattttgtcctcaatgagcttgcaaagtttacttctgcgctcttcaacaaagcgtcggtaaatttgctctatattggtcatatagacacggagtaattctcgtcgataagggcgatcgaggcaacgaaatgggcgatccactttctccctccagtattgaaaagcagaagagaacagttactgaatgtccagcaatcaatttataagtatataaccaaatttctgagcacaccatagttgagcattgacaaattaaacatagaagctaggacttaaataattagagaaaatagaggcattaacaaagagagatctttgaataaatcgcagtataacatgttgcaacatg

SEQ ID NO: 69627 - DNA, 2132 bp, Oryza sativa
gttttcgctagctttggtgtcacatccatttgtggaaaaatatcaggcaaaccccttttacctagattttaccaaatgggcactactgtgtaaaatgatccagtatcccaaggtcttattcaacaaatacatgacagagaaacatgtgcactgttggttcaaactttacactcagcacaacctgttcaacaaggatttccccctggagtattgccgaagagaatgatacgttaagctgtggttgctggcatggcatggcatgccgcctaagtcataaccagtagaatgccaattcattctgctggattccagcgctcatgccaattaattccgcccgatttcagtaaaatcctatctttttctgcactagaagccacacataatgaagaaagttcctgatttgaccacttcaacctacctcatcgtggaagtaccgatttttttgcactgcaagcaccttatcaacaaattcccgatctttcttcaccaaaagccctagcatgagcacccccaaacaaccaaactaaccatcgcatcctccccactaaacggatccaacctacacaagaaagccgaattcgcacccagacggagaaaagatcaagcaggggcacataatggcagcgctcgaagcaaacaagattcgctaaagcacctactttgcccccctcctccagcaacagcagagatgggttcctagaaaacctacctactaaccaacaaggaatacttaaagcaatcgagttgcgagaggtaatcaaagatgaggtggggaggaagggcgcagggtgcgtaggtagaatgagagcttacgacgttctcgtagaggcggggatccaggtccatcatggcgggagaggcggagatccgcggcggatgcgaggtaaaggggggacgcgggcagcaggaggaggaggggagagaggctgccgtgccgccgcgctgcctgcctgccgctggggaggccgaagattcccaaaaggggattttaacgaatttgctaaactacactatttaagttacacgagtgcattatttttctctccttctgtcttgggagagtctcttcaggttattaacgacttttctttcgacgacttgaaaaaaaaaagagatttggagtttaagaaaaaaaaaccacacacctcttgccactatcctattctctctttctaacaacttaagacgggccaacagaaaataatactacgaccaaagaaataagtccatttaataatctcatgaattttatttgtttaaaacatactccacctttttttactttatagaagactatccaacccaaaaacttttaatttatatcccttcatctaaatcggaatgatttccacttacgtgaaactaatcttacagtctagcaaagttttttaagaaaatgacaagccgacaaatcaggactatcttatatactccccatttaccagctaacttacttattgactatatcagccgacggtaagggcagttctttaaactccagtgcctcatgcttcatagactccgcataggtgagattgagttctaataacgtgttaagctccttcgtcgagtttcatggttctaatcattgtcttatcattgcagataagctccagatccactatgtcttcttgttgagcttctatcgttaagctccatatgaactctctacatcctcgaactccatcacctcctcctccacaagctcgcagaggtgagctcgcaagctcaagcatctcctacatcgagctttatatccccgagctcattcattgttcgttgtcgtctcatgagcttaattatccacccccacattcacgaggtaggcaccccacctaacctccatgtactagattctccaccgaccttcaactctaccattgtctttgtgacaagccccgagctccaccgcagccatggctctccccatcgaagtccaagagtacagtagtagcttgagagctcgagacacgttggatatgtttagtgttaatatatgtaaaaataattaaaaaagaaaattgttggccactgtatagcgtggagcattgtaaatgctgttagagcaagtttaataatagagccaagtatgagcttatagcttatattaggttaacatatatagtagatca

SEQ ID NO: 69628 - DNA, 1068 bp, Oryza sativa
ggtccctaactgctctcttctctcattctgtggtgtcttgcaggtcgctgagcggtagccgccgttgaggaaccggagtgccgacgatggacgatccatcctcttgcaaccacgagttgaggttgatggggatgcggggtgatgacgaagatgacttggaggaggaacatgtgcaggtgttcggaatcacttcgtcacctcctcacttcgatgggtcgcagccggagacggagccggacgtggacggtaccggtggcggtgacggtgatggtggctcaggcgcgttgtccggcaccgactccagtgctaccaacaagcggccaagatcatccaaggtatgggatgacttcgaagaacactttgaatcacgcaatggcgcgaaggttcgcatttctgctaaatgcaatcactgcaaaaaaaactttgtctgctcattcatctggtggcactggtcatttgcttaggcatctcaagtcatgcaaacctagaactgctagtaatttgtcacagtctatgcttaagctcaatgctgatggtactgttcgtccatgggaatatgatcctgattatgctagaactgagttggttaaattgattgctgtagaggatctaccactgaattttggtcaatctcctacttttgaggagtacattcagaatgttcataaccctagattccaagctgtctctaggcaaactattagtagagatgtttttaagtactttgacaagagtcgtgctatgcttattgagaggttcaagtctgttaactctgttgctttgacatctgatatatggtctggtaatgctaaggaggattatttaagtgttgttgctcattttgttaattctgattggcaattagagaaaaggattttgggtttggtgctgattgatgtgaagcacactgctgagaatattactgaacgtgtgctttctgttgttgaagaatatggtttgactgataaggttttttctattactctagacaatgcctcttctaatactaaggcaatggattttctaaaacctaagttgtctgcatatgttggtgatttatatttgcat

SEQ ID NO: 69629 - DNA, 849 bp, Oryza sativa
ttttcttgggcagactttctcaatccaggacatgatcagtatgtgtaccgccatccaaacgggtgagctcccaagaaatcaaaattagtcttccttagaaaaaaaaatgttagaatgggtttgttgatgaacttttcatattcacaaggtggatccaaagcaggtcataattcactgtggtgtgttttccccaatgagattatatgtaggcaataggcaactatgtctagtgcattcttaaggaatatcatcataccattggtttatctttttgaggcatgcttcaattttgtggtagttaattattttcatatgtagcttgagctgaaacgtgccactccatccttcgttttaattaccgcgtctatgatgaagctgaactttttttttctcgctggtttcttctgtttctcaaaagatcagattgtgtgtggttggtttagcttcagcccatattgcattgaaagaggaaggggggataactgccgttgatttcaatgttgggaagtcagaccgcagtgagatgaaagtcacaggaaaacgcaaaagggtaattggatgacttgaactcttgaagcatgtttttatcattggttgacttattggaactatggaagcatgactcggttcttattttactttacagaatgcacaacatttgcaagaaaattcagcgctgtgtaaagtctgcacaagtagtaattcttttgtagtgaggttggtccactagatctcccaatcaataattgataatgccattctatttttgcactgagttgttgtttatgctaaactcatgtaggtgttgtgtgaaaagatcacctttggagatcaatgatagattgatca

SEQ ID NO: 69630 - DNA, 15358 bp, Oryza sativa
  unsure (1)..(15358): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagatgctaataggccagtagcaattgatgcaacttaataaaagcttccttctatgtaaaagaaagaaattgatgcaactcatgttacattttactttagtctgaatcaatatatctgaaattttgaacagaacatactccctcatttcaattgtccaccaaatgcaactcaaactcgaaatgcttggcatgctggcaaacaaattatgttttattaagttagtaactgttgaagtattcttgtagacattatacaatttaggagcaaggaagtttgcagtgatcaatgtgccattactcgggtgctgcccatatttgagaagtcagaacccgaccggagagtgcttcgaaccgctaaaccagttggccaagagactgaacggcgaaatccgggacctgttccgtgacctcagctccgaaatgcagggaatgaagtactccattgccagctcctatgaacttatctccagcctaattgaaaatccacaagctgctggtaagttacctcagtttaagcaaagagtaatatgacctggaactcacacctcaaacattgtcacagttctacttagcatgaattgaattgtaaccgtctacttttcagctatatctgagatctcacagacttgctgattgatttcagggtttgtagaggtgaagagtgcatgctgtggtggtggtggcaagttcaacgccgaggaagcctgtacccccagctccagctgctgcgctgaccgtagcagatatctcttctgggatctcctccaccctacccaggccacctccaagattgtaggccttgccttctatgacggggcagcacggtttgtcagtcccataaccttcaagcagctggccgacgcatagcatttcggcatcagaactagaacttaggattcactagaccaagacaatgcttgtatcaatctacagcatggcaaagatgctgaactatccaaagaccaaactatctgaaaaacctacataagagaggtgcttctcttatgctttaccctttgagaactgcagaaatggtgacagaacctgtcctagttttctcatgagtgtaagtaaaaatggttgctggttgtccccattaggtgattgatctgtgctctcctcatccaccggagagctccagtcagtggccagccattgcttcaccctgtcgcgcttggcgacaagccggcctttgttcctcatggacagcctcagggggctccccatcctgctcagaacctcctgagccagctccctcaccttgggctcacctctgacatcgctgtgcttgccaatgccacacaccactgacacctccaatggcaatgcgcggcgcgccttcatcgcatccacccactgcaaaatcaaaacataggctgcaattgtgctgaatccatggaggttcagcttcacctccgactccgaccaatccatcgccttgtcgagcaccgaagaggatgtcaggagctcctgcaccagctcagcttctgctggccattgagatgcagacctgagcttcttgaccaactcagccgttgacaatggcagtgattcccccaattcttgagccatcgaagctactgttgggcatgagttgagcacaaagttgaaggccttcgtcgtcggcgcaatccgcagcttcctcatcctcctcagccatgccagcatcctggaatggtcacggcaggaggtgtagcacgagagcacgatgttcgccgcgccggtgccgaggcggatgccggcgtcggacatggacgagatcaccctctccatctcggccatggatcccgccttgccgtagcacttcgccaccaatccgaactggaacgcctccggctggtgcccccgagacgccatctccctcagcgccgcctccgcctcgccggcgaggcccatcaggcacagagattttatcatcgccgtgtaggtcttcttcccggacagcggcggcgaggctcgcagctgggagtagaaatccatcgcccggtctcgcatcccgcgggaggagaaggccgccatgaggtcgcagtagaagagggacacctcctcggaggaggaggaggtggagtggaggcgcgagatggagtcggagatgagggatcttgattcctccgcgctgccattgctctcgagcagcgcggcgacggcggcggcgtggatggagctccacttgaaccaccgcgcctgggtgaccacctcgtagaactgcagcgagaaatcaaatcccaccccaaattcgtgacgcgaaatcggcaagaaatcacaagaataatttgggacgcgctcacgcacgccgcacgcgcaccgggatggcgaaggggtcggagtccatgagcaggcgggagagcgcggcgagggcggcgcgctccgacttggaggcgacgtagctgcggatgacgcgctccgccgcgccgggcgtcaccgtgcgctccagctccgacatgagccgccgctcgctccgccagctcgagccacctcccgccgccgcccgccgcagggacgccaccgccacgttcaccctcctccggcccctccccccggccgccggcgatggcgccggggtcgagagcgacgccgccaccgccaccgccatggctggctgctgcgctgctcgcgagcgacgcggttggcgcgtcacaagatgagacgtcttatcaccaacgggtacacatcgcaaggccggcccagtaaaacaattcagcccaaataggcccaccacatttggattagcgacccaactggacccaccagtcaagcaagcttcatgcatggctgatggggcccagttcgttagcaactgatgcagttcttgtcacgtttgactttattctgaaccaaaagtttatctgaaaaatgtgagctcattatgtataccctcattttgaaattgtgaacaaatcatacaccctataccctcattttgaaattgtgaacaaatcatacatcctcattttaatccacgagatgcaaaagatgcagtcgtgcaactcaaaactgatcactatgatgatggaatgccaaaaatttccaaacatgtttttagcaagggaacaattatttgcatgtattactgtgctcgaatttaatgattaatcgtgaagttttcagtttttcggcagaagatcaccaacttttgtgtaacacgctccactttcaacaagatgtcaaaactaactggtagaatataatgcagatatttttttaaaaaatataatgtatagaaatctggcctctacgtccacaagccacatccaaaggttatacgaatatttagattttaagtctcgtaacgaaacgcagataaccttggaaaatataggcatacactacaagattttcatctacaacataggaggagaaaatcggaattcagacatgaacaagaaaacaggatcaatttgtacaactcttttcagcacattcctttttctatacttgttctcattaatgcaacaaaactagaacaagaaaaacaacagcaaaagaaaccaaaaagctgaaaaaaaaactaaataagcaaaaaaaacaaagctgcaacaacgtaagaaatactttttttttaatcactgtacaccacaatgcgcttccctcttgttgtgggatgctacaattgaatgatgcaccaacattgtataagctactttcagtggtttctcttcaatgctgaaagaaatcctgcctttgatttctggcgaccctcggtatcagctctcacctgtttttttaaatcaggatattaaaacaaaatttaatatatatttttctggagcatgatattgaacatgaaacaaactaaaatttcattgagcaaatagtttctgtttttgtaaaagaacaaaatcttgagaatttttaagaaatgcatgataaattgatgagtcgaggtgcattagaactgacctctttggggagtctctgaagaatctccagtatctgggagaagtcaggcctttcagcaggatctctatgccagcatttctgaagcagctcagacagcttggggtgcgtatctttcggaattgttggtctaaggccctgcagaaaatgatcaaaatacacatgagtgaaccttaattttgtgtagaattgttgtaaataactagcagctctctgctacatatgtacaagttaaaatgctgtcttgcaactcttttagataccaaaggcaatctcctatcttaggccttttatccaaaaaaaaggccatactttatgaaatcaagcaggtataccgtatatatgcatgtatatgaggatatagataaatatgccaataaatttccatgaaatttctaggtatgtacagtgtctctaaaggacctatattctcttgaaaatacttgtcttttcaaactactcctacttggcaatcacggcaactatttcatttacaatcaaggttcataatcattttcatatgcaattcatagcactttctgctaatggtaagaatctatgatgttaagcagatattatatgtgaccctacaattgagggagctacaatgacgtgacttgacggaagtttgttctacttcatctcattcccatgagcatggtaacctgaaaacctaacttgcacctctaatcaggtgagtgattagtaggatggacacaaagggaggcaatcgcatattaaaagaatggtttcttgaaagaacaaggatgccatcattttttaaagactgcttctcgaaactactgtatccttagagcatcacacatgtcccccacttgaactaaagaaatccagcacccacaggacatagctatacaatgggtttcatcaacattttaaatttttgagctaaatactacggataccacgcatgtaactacagaatttaagcagggatgcttgcttaccttctgaacaacacctatggctgcttgtagtggtgttaggtactcatagggtatctgagaaattgaatagttaggtgagtttagttttatatgtaattaatataagttggacaaagaaagaaagaaattgactttttcctggagcaatttgtagttaccttgccagttagcagctcccatagaacaataccaaagctaaaaacatctgctttatgatcatagggcttatgttcaatgacctgtagttacaatagaatacaaatgttagaataaacaaaaatgctgttgttattcttatggaatgagcgtatgtataacaggcacctcaggtgccatccaacgataagttccagtctctgcagtcatcactccggattgatctttgacacgtgcaacaccaaaatctgcaacctttacgacctgaaaaatatgatcgctctcatttagaagttcaatgacaggagcaaatatcactctgcacactctgtaaatcatatagcattatggatgagattatggatgagaaaaaactagccttgttttcatccataagaagattcgctgtcttgagatcacggtgaattatgttgttctgatgcagatagttcattcctttagagatatctgtcgccactctcagtatttcggatagcttgaaagaattgttctttttatgaaggtaatcatgcagactacctcctgacatgaaatctaagaaaatgaatgcaaattagagtgtgtcaaacactacagaagtttgtctacaaagattataagttaaaccgttgtaatatacctgttacaatatataagttgggctgtcttgtacaggcaccgataaactgtacaacatttctatggcggacctttctgcaagcatgtagattttgtaagaaacaatttggtacagtcaataaagtcaatatgcatatgatttgccaaatgctaaacaccagaaaatgctcgataaatgggagaagcaataaaaaaatattaagttaacctcataatgtagacttcctgtgcaaaatcacggtacatatctgcactaatgcgttcaggtctcactactttaatagctacatcctgactgcagtatgatccacggaacctgagaaagcaaagcatcaaatggcactcaatccccagttgtgtaaaattatattgttttcacttcccgacaaagataatggaacttacagatcgccatttgatccagaagcaaccttggttccaaacttgagaagcttgagatctatctcccaaacatgcgtcccatctgttggtatttccacactggtagatggcatactctctccacctgacggaccttccaatgattgtgacgatgagtttgatgttggccaagcttgtgtctgtacacgaaaccaaaataaaactaaaacaaatgttttttatctgaggaattcaatagaccttacaagatttttatgagtgcaatgaacaaggcaagtactggttaggaaaataatgttctgcattcctttttcaggtccaggtaccatattttcaggcaacaattaataccacgagaatgagttttttttttcgttgaacttcatagaagaaagtgaggggaagcttatacctcaatgtcatgaaacttctccagcaacttttcttttagctgctcagtaccctgcagtgtgcatcaaaagagcaaattatcaacacgaaaagtgaagtatgttactgaactaactgaactactgaagcgtttagctctaaagaccaattgcaataaggacaagacaaactaacacagtaacactattatgctgggtgcgtaccccaaggtgccaaccagtgacaacaaatacatccaatgagtaaccatcacttgttgaaaatgcatgcgcttcttggatgtcaagaccaagctcactaagcaagcaagtcagctgcaagtgtatgaaaggcaaagtgtaagaatcaaaacaattgctgacataagtcctgtataaaattgccttgaagttcacattaaacagatttgtaatgtttttttaatctttttttctaaataaatatgtccatttatttttactaatgattttcctaactagctacttgtcagcttttgaatttccttcgctttgttaagattgtattgaaagaagtatgcctacctgactaaggacctttggcttatcagttgttgcaaaagttatctcatgcattggcctgcaagattcagaatatagcgagaattaatcaactagaatgagaatatatagaatccaagtattaatcaactatttgcataatcctaatgaaaatgcccataaatacttcctccgtttcacaatgtaagtcattctagcatttcccacatcatgtctagattcattaacatcaatatgaatgtgggaaatactagaatgacttacattgtgaaacggagggaataaaggcttaagttggaaaaatgaactactcccaccaattatgagtacttttgacaatttcataatccactcactacatgatcaaaccagcgcataacaaagaagctcatgcgtggcatcggctttttgtgaaatgtcttgtacatctaaacaagtatgcaaatgcaatattgccagagaaagtaccatattcggaaaggaaattctgcatatcatggttttgcagctaactgttagtaacaactaatccactgatgctatcatttgttaaaaaataggccacagaggcatgcattcttcacaaggtaaaatatgcgattttctggttgtaacacaatataccatgttaattaattgatatagagaagtatcaaaaacagtttttaaaagggaatcgcaacatgccgacatgccaaccttgtaaggtagtagtacaagactacaagctagtgctaagcacgctatgattgtacagaatggcacatgaaccaaaagaaccaaagacaaatacagtgggctcctctgaaacacgggattgagaaaacaaaggaataggaaaaacacagaatttcgataggaattcaaacgcaaaatagaggattgtaaaacacaggaaaaattcaaaaattgaatgagagagatagactcatagaaaactttccatgaggttggacctcatgttaaaaatcctccaaaacttgtatggaatagagcattccttaagaatttcataggattcaacagttttcaatcatttgtttcaaagggccagataggaaaaaaaacctataggatttgaatcttacaaaaatcctatgtttttcattcaaatcaaaggggccctaaactcaaaataaagcgaggtacacgtgaactgaaaaggggaattatctacctggaaatgagatgaacactgctatcttcatcattgttactgctccttagattagcctcactcgcctcgagcgcaagtgcctctaagttggagcaagaaccaaaggcaggagggggatgaaccctgaaacgatttgtgtagtcaccattactccattagcgtgcataaaagacaagaacagccaaggagacacatgcatgaaagtaaacgaacttcatgtgcatatagatagatagatagatagatcatgcatacatttgtcttgccaagtggttggtatgaaccggctccatcccaagctcagaacaatcatccatatcaccatcaagaatcctagaaacctagatcaagcagaaaacaaagtttggtaagccaaggaattaaaatgtctcttcagtttgatgcaacatctaagctctactcttcagtttgatctaatgaacaacatgagacagcacaaatcaaattccccgagcaacaccacaggagagaaataaaaatctaatggaaattaagcagtacgcgaaatcgaccgacatgcaggcagccatggatggatctctctcacctggacgacgcgcaccgacaaggcgggccgccggtccggatcgcgcgcctcctccagcaaccggtggtgcgtcaccacgtcctccgccctatccgcgtgcacatccagcgcgtacctgcacgcccgccatggccatgagggaagtcggggagggggagggagggggagagagagggcaggagaagagatctcaccgggcggggaggcggtggaagtgggcccagagcgcgtcctcgtaggccggcgagatctcgacgggggcggcggcgccgaggccccggaggcgggcgagtacctcgctgtacacctcgaggcggcgcccgctcttgtccgcgcgccgtccccccgcgccgacctccgccgctggctgcggggacgacggcggcggcggcggggacgacggcggcggcggcggcgactcctccacggccatcgattactctcgaagcaaagcgagcgcgcgcggcggcgtggtgcacgagacgagagaggagagccgtgccgctactgctgctgggtctgcatggggtggtggtggcgcgcacgtgagacgtgacaatggcggcgagaaagtccacaactttatagacacaaacaagcggaggcgctcgccgtagagaagaagaaaaagatgagaagagagacaggtttttgtctaggttctggattgacttcttctcccctattggctggagtaataatagtaccattgtaccctcaacgtctcaaaataaatcatctcttactaatacacaacaaatctagatatatatccatattcattgtattcacattttaatacgaggttgatttatttttgaaacgaagggagtaatacaatgatccaaacaaaataattcaagattaatggtctgtttcgtactagcttcaattccacttattctaaagttcaagtccagctaaataatttcggctccatccagaatagaagtggagctagttaaactccaaatccagctcttggaattaaattttgaaaaacagattctaagtataatactaagaagttaaaaaaatcacaatttttattaggtattaaactccttccgtgtttagcttatttggaagtgaagtttaaaatagtattaggcttgaaatttaagtaaatttatgtttttattaaaaacattgaaaaaaacaagttgtattttaattggggattgaatattattggggataaggctgcagaaaatgggggtgatgaatctggaggatttggatgaccataataaaatatgaggacattaatccaaaaccgagtcaaaaatgtgatgtggagaatggagaacggttacacacaagccatgcaatgaccagtgaatcagtccaaaaaccattgctttctcctcgacctgtgtgcatgcgcagtactacaactccaaggtcaaagcagacattgcacgtggtttatttgctacgtccacacgtacggtgtgtatgaacccggaataaaaacattgctttcacaaaataaaaagaaaagttactaccatatggttgaactaagcaacaattgaagcatcattttaaaaggatgcaactctgagcgagactcaaaatcaacttcaaactgtgtaacgagaccatgggcgggaattgtatatatgtgtaccgctggcttctcaccaaaaagctctagtattaaatttataggtggtacctttaatatttctatattgatatgtttatatgtgtctatatataaatagagcgtacaaaatatgacaaaattggagcttactcggcgaaacttgcgggcattgatgaggcaatgtactaacctaactaagctagttaggttcattatatctcatatttgggctgggttcaatggttcatccagcctagacactcaaaaagtgggcaagataaacaaagatacaatattgcaatttgaagcactagtagtaccagtgagcaccatatcatagcaggatagtataattaaatcaagaagatattgtaaattatttggttagtattttctataccatgatggtcctatatgatactgctaactagtactgtatgactatactgttaattggagctctttgagcatgtaacaatggtagcaagtagaaagtagctagctagtcactgaaacgtacttgtacgtacgtaattcaagaatgatagataagctaatcaagtactgatgagataacattgtccttatttatttgtttgaggcgattttctactaaccaattttttgataaatacagacacagcgtttgtggtaagttctgaaaaacttcgcatatatacacaccggagggaacaaaagtaaaaggaaacttcgataaatcgtttttctttaatttggatagtatgagtgatttgaatttgaaggcatcaattttctgacggtatagcgtgggatctttttcagggtacgtattttgaattgaatggaatttagcttggaaattacccactctaaaaaaaacttggaattaaaagagtggtgccttgcttttgcctatgacctcgttctcttaaactatatatatgcagttcacctttcgaggcggagctggatatgcccatgtcgatcctccgcatcgcacagttactccatgcacgaaccaatttttggtttggctaatcacgccacgtgtactccaccatttctcaaaaagaccgtgttttagcatgtgtaaaggaatatgcgattgagttttaattatcttcttcgcccattgatataattagtaaaaaatactactccctttggtattatttgtttgacgttgatcatcgtatatacacaacttcaatcagtaattttcactactccattcgcccctttaagataatcgattttaattatttactgctccttactctaccaactctcatctcgtaccaactctcgtctcatactggtcgctagcttctatccaatctctaactaaaaggtcgtcgggcatatccatagtattgtaccccagaacgtgaaacgtaagcaagtggacatttatcaccttatctccgaaaaaaagatagattacatcgctggctcgagcttgagtcttcgcatcggtccaatggtgaggattcacttgatatataaaatccatcataaaaccatgttggcatatttctagcgaaaccttattcaatttgacacatggctcgagacaagcagcctgatgtttttagaatatgcttggggattaaacccaacaatcatacgatgattgatctccacgtctaatataagcatatatagttgtggttaacttaattaatcagagaggaggaatgatatttatatcaagtgctgaacgagatcaggactccagcccggcacctagcaagtactcctacgtagtacgacacatggatcgatatccatttatactagtggatcagtagtttacaattgactcgcaaaagcaagctaagcatcgagttaacatcggctagctattccagtgacagtgatttggtcctaaccaagtggctgctgaattattgaccgtttgcaacttaaattaattgttgtttttatcactactacttgatctccgactctccgtttgagaacatatacgtgttaagcagttcaaaattaaaactgaaaaagtcatgaacagcggcagaccagagatatatatagatcgagaaaatatatatagtaaatgcacgatgtgtaacctgcatttttgtcatttagttaagcaataattaagcattcattatccaattaaaaagcaataagcattgtatattcagagttgcaggcgaagtcacgcaacaaccgatgatcgatatcgattcctggcgtcgcatgcgtgagtacttgtgcctgtcggcatcagacaaattaagcaatcgattcattaattaaacatatgtgtgtggagtagctataaccttgcagagaatcagatcgaataagttaaggtaaacgataaagataacataagaaaatatatcaatagtagtaattaagtctgcattttgtttttgctgggaaagtctgcaataattagtagtaaaaaaatagtgttggatccaatcgttttgcagaatcaagtgcaggtttgacctgaaaatgcattgcagcatcagagtgagagatgcgtcaaattaaacgagcagtggcgactactggacgggctcgactggccgcgtcacaactacaggatatgcatgcagctggacacgtagcttcatcgaccgacacgtaggcatgcagagatacgcgatgtctgacgaaattacgtttataaaatttactactccctctattatatattataaatcgtttaacttttacatagtcaaacttggttaagtttaattaaatttataaaaaaatttagcaacatataaaatatcaattagtttcactatatctaatatttaatatattttaataatatgtttgttttgtattgaaaatactagttaaatttgaatagatttaactaggaaaaaaagaaaactacttgtaatatgaaacggatgaagtagttgatttggctgtgacttattgacataagatcgaagatgcattctttttattattattgaaacagagcagcagatagatgcttctcgggattttcagaacgtgtcatgaagataggaataccagaatttatacactactcctatcatgtgccttaggatagtacaggcgtactataatatattgagttattcaccatcaattcattcagttttaaacccctttaaaaatcatccatccaatcgtggcatttttaaataatgttttgtttttgaaatttctttgcatgcatataaaataaaaagggataataataacaatactaactatcatcatttgtgccactccaagaaagaaggaatgataggaaggagaaaaaaaaagaaaggaaaaggagagatgaggaagagaatgttcagcaatttggcccatatattaccgatgggccttccaaatacgtataacgtggcccatcaacctggttcgaattacgtatgcagcccagcaacatgcgtccggatacaacacacacaaacacatgctatgtttggcctaaaggtctaaaaaagttataacaaaataataaatataaaatgtattcatatcctaggtagagtttaaatatttttatttaatttgtagaaattaaatttaatgttgtatgtttgtggagtgatatacggataccttgttaaatgttaataaaatttttaaaaattttgatagctatttgggtaccttgaaagaaatgaggtaacatccactcgaggaaaaggaccatattctaataattatggataaatttaaacgcttatcatttttatatttgtttacctatggagtaaaatacttgtattctgattctacacaggcctgatcaacgatgtgcttattatgctttatgctacttgtaacttgctaatgaagcgcgattacactcgtgactcgtccctgatgccgcctgtcgcacgctcttctcaagccaagaatcgcattccttccttgcatacatagcatcatttcatttgcgttttcatgcatgcccccgtggggcccaccttagtagactgcgggcccaccggtcagcctcctcttgtgcattaattcagcaatcctcccgccatgcatgtgccctacgctttcacaccgttaatggttagcttagctagcccccgaagcggccgagctccggtcatcatgtcttggtccggcgagctgtcgccgccggcggcggcgtcggggactcgcctcctccacggcgacctcgacctcaccatccacgaggcgcgcggcctccccaacatggacttcctctccaccctcctccgccgcctctgcctctgcctccggccgccggcgagacggcccagccccggccagagccgcggctctgtcccggccgacgaagacggccgccgccagccgcacggccaccacctcctcccgacgtccgacccgtacgccgccgtcgtcgtcgccggcaacacgctcgcccgcacccacgtcgtccgcgactccgaggacccagagtggtccacccatgtcctgctccacctcgcccaccacgccaccggcgtcgccttccacgtcaaggacgccgaccccttcggctccgacctcatcggcgtcgccatcctccccgccgccgacgtcctcgccgcggccgccgcgcccatcgtcaggagggagctccccctgtaccgccccgacggccgcgggaggccgaagcccagctccgccatcgtcatcaccgcctcgggggtgcagga

SEQ ID NO: 69631 - DNA, 2536 bp, Oryza sativa
tgaagctgtaccaggacgcgcacgtggccggcggcgagctggacggcgtgcggcggcgcggggtgttcgagccggggcggtgctgggaggacatgtgcctggcggtgctcggggcgcagcacctggtgtacgtggcggggtggtcggtgaacaccaaggtgcggctcgtgcgggaggcgatgtcgccggagatggcggcgaaggtggaggaggtgcggacgacggcaaccgacgacgacgacaatccggtggcggcggagggcatgtcgctgggcgcgctgctcaagtacaagtcgcaggagggcgtccgtgtctgcctcctcgtctgggacgacaagacctcgcacgacaccttcttcctcaagacagttgcgttgcgtaccaactcaattcaactctgttcttgaatttttgtcaaagaaaattgaatttggatttgatttctcagggcggcttgatgcaaacacatgacgaggagacgaagaagttcttcaaggactcgtcggtgatctgcttgctgtcgccgcgatacccaagcagcaagctcagcatggccaagcagaaggcaagatataattaattactcaatcatttccaaaatatattactccttttatttttcacatcgtcttatttaaaatatatataaatattatttatttttgttatgacttgttttactatattcttattaataacttactccctccgtcccaaaatataatctttttttttaccttgatatggtctccgagatgctattttgaccaacaatattaagatgctttaaataaaaatagttgcatattataatagtttgtttaatgataaatctagtaacatcaattttacatgtttgatttttttttattttttgttattaatggtcaaagttgaaaaaatatttgacttattactatgctaaaaatacttatattttagaatggggtatatacttttacatatttatgctaaacttttagataaaataataattaaacgatacgtgaaaagttaacggcgtttgaaacgaaagtagtatcacaagtaaatctcgattaaaaatggtgcaatgcaagcaaagcatgcaagacccaatgctgagaggggcgtgtcagccagcgtgcagattgtggggacgatgtacacgcagcaccagaagtgcctgctggtggacacgccggcgtcggggagcacgcggcggatcacggcgttcctcggcggcctcgacctcgccgcggggcgctacgacacgccgtcgcacaggctcttcgccgacctcggcaccgtcttctccggcgacgtctacaaccccgcgatcccgccggcggggaacaagggcggcgccggcgaggaggggccgcggcagccgtggcacgacatgcactgccgcgtcgacgggccggcggcgtacgacgtgctggagaacttcgagcagcggtggaggaaggcgacgaagctgttcagaagggccaaggcgcactggaaggacgacgccttgctcaagctcgagcgcatctcctggatcctcagcccctccgactccggcgccggcgacggcgacggcggcgacagccacctctacgccttgcccgatggtcaccccgattgctggaacgctcaggtacatgataaaccgatcgattgatacttgaaatcgatggagataattttaatttcttggtgataaaactggcaggtgttccggtcagtggactctggatcagtgaaaggattgcctcgttgctgggagacaaaaaagatggttaataatctcttcttctctcttcatcaatggctcatcgtcattaacttatcaatcaatcaatcaataatcgacgtactccctccgtattttaatgtataacgttgttaaatctattatcaacatttggccatttgtgttatttaaatttttttacagatataaagatatttatgtcatgtttaaataacgtttgatgataaatcaagtcgcaataaaatatatggtacttagataaattttttaaataagataaatgataaaaaatgtatcttaaaaaataaatagtgtcataaatttaaaaaataaatagtgtcataaattaaaatacggatggagtaataaaatggtactccatcaaatagctgaagcatcgatatgcgatgcaggaggcgaagcacctggtgtgcgacaagaacgtgacggtggagcagagcattcacacggcgtacgtccgggcgatccggtcggcgaagcgcttcatctacatcgagaaccagtacttcatcggatcatccttcgcatggccatcctacaagcaccaagaaggcaggcaccatctgaatttgctgaatttgtctcatcacttgtctgaatcggtaaaaatacatggagcttagtggttgcagtcacctgagtaacaccctgacaccctaaggtcatgagtttaaatcttcatacgagcgaattacaattaggttatttgaggactaaattcctaatttcatattgggttatttgaaggctaagttctcagtttgttagactaag

SEQ ID NO: 69632 - DNA, 1331 bp, Oryza sativa
tcctgcagcccagctcttattttaaaaagattcatatgtccggttggatgtagaggctgtaccaaaaataccattctctaacaaaattgtctgaatatgctgcacactgatgcatgtatatgtgtgtgtgcaggtgctggaaatctggtgccgatggagatcgcgctgaaggtggcgagcaagatcgccgccggcgagaggttcgccgtgtacatcgtgatcccgatgtggccggagggggttccaacctcgggccccatccaggagatcctcttctggcagaggcagacgatgcaggcgatgtacgaggtgatcgcggcggcgatcagggcggcggggatggagggcgcggcgcacccgcgggactacctcaacttctactgcctcggcaagcgggaggcggcggcggcggcggcggcgggctcgccggagcaggagcacaacccggcggccagcagcgcgcggcggcaccggcggttcatgatctacgtgcactccaaggggatgatcgtggacgacgagtacgtcatcgtcggctccgccaacatcaaccagcgctctctcgccggctcgcgcgacaccgagatcgccgtcggcgcctaccagcccaatctccgcgccggcgccggcgccggcgacggccaggtgttcggcttcaggatgttgctgtgggaggagcacctgggcagcagcgagtggcgggagctgaggtcgccggagtcgccggagtgcgtgaagcgggtgaacgagatagcggcggagaactggaggaggtacgccgccgacgacgacgatgtcgccatgcaggggcacctcatgaggtacccggtggacgtcggcgacgacggcaagatcagcgagttgcgcgggcacgagttcttccccgacgtcggcgggaggatccttggctccaccaacaacaactactgggattatctcaccatgtaggcatgtagctgcctctgcattcccaaattactattcggattaatatatgggactttctaggtgtcttttgacagaaaaaacctccctaaatcttgcaaattatgaaccgttggatcaatcgtgcaacataagtaaaacctacttttcctccttccgcttctcagtccatccgtcgccgccgcccggcctcgcgggctggtcggaaggagtcaacgacagcggcaagcccccccccccctcccatggccggcctcctctccctccccccttctctttccaaggttgcacggcccattttccccccaccgccaatgccggctctccgcccgctgccaaccccgcagctccgacgccgctgccggcgcctcgtcgcccgcccgtgt

SEQ ID NO: 69633 - DNA, 2863 bp, Oryza sativa
cccccccccccccccccccagtgttatgggtgtctctccaagacgcctcgctgccgcgatcggtaaatctcgccgcgacgtgacgagcagtagcaccatggctgcgagtgaaggtggtagagatggcgacgccggggttaggggtgattcgtgcaggccaagtgctcggcgaaatgccgcacccggctgttgttgatcggctctcgacaagtcctgggaattttccttttcagaaaagaagtcggcttcggaaattgttgcttatgattctgcatttttgttttggattcaattgctactgccatctctgagtttctttgacacaactgctgttgcctcgtagaatatagaagaggattacgggatgtttgtctggccatgcagtgtcattctagcagagtacgtgtggcagcagaggtcacgcttcactgcctccacagttgtcgaggtactatacttgtcatctttaaattctactcttgagtgtcaatggccaatgatgatctacttgccattgtgatgatcaaccataaatcaggtcctagcgccagcctctgttatgaggtttggtacagccattatgacattctgttagtagtaattgtatccagttcagagcatattttgcactctaattttaatttgcatgtacgactttcagcttggtgccggaacctcactaccagggttagtagctgcaaaggttggagcagacgtcacactgacagacatcgcacataatacagaggttaagttcattcagaggggtgctgtgtttcattcatctaggctcatattaattattttcttcttatgttttatcaataggtcctgaacaacatcagacaagtatgcggtctcaataatgtcaactgcactgtaagtttttttatttagagggaaatgcatggtggtactttgcattctgctacatagcttaacaaatctgcattctacaacatagcttaataaatctgcattctactacatagcttaataaatctgcattatggtacatatagcttaataagtcgacaacactcatgcaggtaaaggacttacctggggagaatgggatgaacctacatttgacttgcatcctgatgttattcttggagccgatgtgctttacgactcagcaagtaagctacacctacacgggctacacatctgtatttgtagttctgtataattttcatgttgactgacctgcacacaactgcatcaatttggctagagtttgatgatctcttcgcgacagtctcatttctcttggaaaattccccgggggcgatgttcataaccacatatcacaatcgcaggttccgggaattgttttacccttctcctcatggaagaattgcaggaattgttttacccttctccttgtgtgtcaactatttgattcctgtatgcagtggtcatcatttgattgaatttttaatggtgaagtggggtttgaagtgtttaaagcttcgggatggcttctccttccttccgtcatgcaaggctgcttcactacaagggaacattcagcttgttgagattgcacttgacaaggaaaaaccgaactgctcttcagctgacgagaacaatctgtagcagttatgttccatgcggttcagccttatgggggctgaaggcaagaacatggcacaactttggggcatcctccgcacacaggttaacttttataacactaggtgatttccaggagcaacatcatgtaaaattgcccgtacaaaatattctcaagtttaaccatggattgtatttgttggacaagcttgttaaacgaagattcaccaaaccaatagttatgacagaatattacacatctctacacgggatgttccaacagaacttaatcgaacatgttttccttagtatcaatgagatgataatcatcagacattgcatgtaggagcagcaatcagttgtaatacaaaatgctcctcattgtgaggttaacatgattccaactcacaaatttgatatgccacttgatatgataggaccgtcaagtattagtgtgtagctgatgaaacttctatcagactgtccagcaaagcacacacgagaacttcctcttcattagcaccagtacggataaatctggaatctggattgttttcaaattccgtaaacaggtaaataaatggcagtggaccatcgtgcaaggatctttcatcctgagggaatggtcgactcatgcctaggctgtgggatcattgtcgaaaattcctggatgtacataaaatacttaaaatgtgcatgcacgaattgaattatgcaagaaaacagtactaattgttaacactggaactgaaggaaacatgaaaaaaatgatggagcactagtccagaaacatgcaccgattaccttttggatgtcagcatgttcccctcaagttcttgtaatcatcgtagctaagaaatttatccttgatttttagccagtcagctggctttggcataaaaattgctatatatccttctctgtcagcctaataaaggtgggaaaagtatatgtgttggtcagagtatgaaaaaaaaataaaaacttgcgcaagcagatacagaatgacaggtcacgagtaaaaggtaatgcaatatatgacaaacacacagtgatccacagacttctatcacaggtacagagctaaatgatatctagtcaattcatttgtgagaagagggtcgacctaaacctcccacttcacccacaatctacgttcatgataaatgcaatagctgtattcatgatatatcagacagatgtgcaactttaccagtgtttatctggaatccaactagtttttttattctaatctagtctgtgatttcctatgtatgacttcatg

SEQ ID NO: 69634 - DNA, 2382 bp, Oryza sativa
tctagggttgcggattcttccgccattagggcgcgcgacgcgtggatctcctccgccgccggagagctcgtgccgcgcgtggccggtgtgggttttgctttgcggcggcggcggcgcgagcagaagagagatattcccgtttagatgtggaattaactttttgccactggacccacatgtcatagacacatgtggagccacgtgtcattgagatagaggtgacaaatagttatttgtcaaatctaaaagtggaaatagttaaaagccccgtgaagagaagggcaaagtgcgtgggagtgtgtgagccgttagatcattcgatccaacggcctacagcggtacagctcgggcgtttcggaatttgctcttttttttgcaaatccccacctcttttcctgctattccaatttgatcctcggcaataagggtacagttcatttttaaccctcgaacattgctcaaagtctgttttcaccattatttttaagaaaatgggataaactctctacgtccaattggatgtacatgtccataagaaccgattgttttttgtcctaaactttaaaaaacaaaaatagacacactgaaacttatttcaagttggttttcatctgtattagtttcatatttgtcaacctacatataagtgacagctacaccattaaaatatgcgtaataaaaggttcaagtcttcaactcaatacatatactcatatttatgcctatttatttttctttttagtggtagacggtgtgttcatcaatagagagacatctacgactataatgacttcgtcgatttctaaataagttagtccaatctctcagaaatgctcattagggtggggatgcatgtgtaccttcatataggcaaatatgcacacatacataagtatatatgtttcgaaaaaaaacagaaagaaaaaatatcctcatttcaaataataccctaatttgagagttgcttcaataatctttggggcagggtttataaaaccgcgcggttaccatgcacggtaaccttttcagtttttgaaaccacggtatgtctcgcggttaccatgtggttttcgcggtaaccacgcggttaccgcgggggtgcggtaaccacaccaaaaatggtaaggggaaccctgttttggggatgcccatagtaataggagacatgcgtggtttcataagggcatgctcaatggtagagacgaaaatggtctcttaaacaatgcaagattattaagagaccatgtctttacaatagttgagacgacaaagactctaatcattaactcaaaaaatattccttttgtcaatattcaatattctttctactttttttaccctcatgcaactttatttccatattacagtgattaagagtcattgttaagccattgtcataaataacagcgatgttttgtctcttctctttctctttcttccatgtcaataaatattcctaattagcaacgctgagagaccactgttgataaccattgtacatgccctaagagcgaatgtgtgcgtgttatataagcattttcgtctgtactatatttcgaacaaaaaaaattggcaagcaaaagtttttccaacaaaagtggaaaaacactcgatagaagtatccacaattctagctagccacatttcagtcatcaagtcattatgcatatatgccattaatcacaaatactagacaactacttatcaaatccattattactagtacgtagcattatgtttctttctcgaataattcgagtgtgtatacactagtagtgagacgtagatggtaaaatcaatcatcatcatcaatcaaacgcgaggtaatgcaggtgctgatggtatccgccgccgacttcgtcgtggtagtgctctccaccggccgccgccgccgccgccgcagcctgcccgccgtcgccgccgtcgaacttggcgtcgtcctcctcctgcggcgacggccacacgccggggtacgtctcccgcgtcacctccagcagcgagtccctcaccctgtccgcctgcaccgccacctcgctgtccctcacctgcaatgcagaaaccaaccagctcggagtagtcagctcgcgagctcgcgttcatggccatggcggcggcgagcggggcgtactaccatgacgcggaagacgttgaggacgagggtcttgtaggtggtgacgttgacgttgatgacctcgaggccgagcgcgttcatggcgtccatgaggcggacgaacccgccgggcttgtgctcccagagcacctggacgaacagctcgttcccctgcacctgacgcacctccagctgcggctccatccggtgcccaccgccgccgcgccgccgaccttgtcgtcggtcattgctgggtccttgttactcctcct

SEQ ID NO: 69635 - DNA, 27922 bp, Oryza sativa
tacgattcgttgcaaaatcaaacggaaatcgatttgaagaagcttttgatccgttcatggccatggcgatcgacgaggaggtaagataccttggtgatgtttgggacgagcgagcggagcttgtagaggtggccattgagcttcttcctccgcttcctctccgcctcgaggttcttgcactgctgcctcttggcgccgccggagcgcccctcgccgtcgccgtcgtcctccgggtcaccgccatgcagcttcctcccctccgacccggactccgccacgccgccgcccgccgcgtgctgcatctgctcctgcgccaccgccaccgacggctcgctcaccgccatccccgcgtacggccacgcgcccgccgccgccgcctcgtcgcccacggcgtcaccaccaccaccacccaagaacgggtcgtcgtcggcggcggcggcgtcgaacaggttcagcgacgagccgccgtacatcagcctctgcgcgtcggcgcctccgtcccactggaagctgggcgtctccggcggcggccacgcctgccccccaccgtcgtccccggcgccgccgccgccgcactgcgccatgacaagctccgccatctgctgctcctccgccatctgcaccaacaccgatcaacccacaaatctatataacccatccatgcaaaacgcaaaggccgttgcgtgcagctaaccgcaagctctccggcgttcgttggctcacgcggatggcgtgagccgccgccaccaccgccgccgccgcagccgcagccgcatcctctctaactactactcctctaaccaatcgaacgaccgaccactcacatatctcgacgcgaagagctcgacgaggccgccggcgacggggaccagcagccgcgtcttggcgccaccgccgccatcagcctcctcctcctcctgccacgcatccaagcaacacacctcatcagtgacagagattcatattcagattcagattcagattcagattcagctactgggttcagtgatgaatcttgcttacactgctgctctgccagatcggctggttcgacagcaatgcctgcgcatgcatccttgatggatagtgacagagattcagattcaccaagcatacaaatgttcagagttactagacaagaaaccatcaattttgcaggtaatcagaacacgtatcgattgattgattaatcattcaatttaccctatggaggaggagtccagtgggattgaagaaggcaggtccagcagtgctgagacctgtgcttcaagctcactgctgcagcagaatcctgtcatctccaagaacctgccattaattttgtgttaatggttgtatatcactacagagataataaatcacaccgtaattgctactttgcatgcatgatatgatatgatatgccaagtaatcaatcacatacctctgatcaggagagagcctccagtagatgcagtaatcccagccatctgaaccaactagaggcctcaatgcagcatccaaactggtgccacctccattgacagcagctgcagctgcagcagcattgctgttcttcatcagcaggtggtctcctcttcccatgtggtgatcacccttgccctagcagtgacacatgaaagcaagaagaatggatgcaagtgtcagttgcagcattcacaaggcctgctttttcttgctgtcaggacaggataagttgatgtcaccaaggatacagcgaaaattcagggtatgatcacagcaagggaacaatcagattcagtctgaatattcatcagactaaagagacagatttagtctgaaaattcagtctatgttgaatcaaattttcagtaacttaaagagacagagatcaaagctgcattcttctggctcatcaggattgtatgtgaaatcttttctagtgaatttttggaattaagcagagaaagaaagataccttctgtcttcctgagatcgcttcaaactaactgacgaactgtggcagtgatcaacagatggaagagagaggcatcagctgatagctattggtaactgaagaatcattttgtacagaaggactattgcatcatgcatatatatagttcacatgtgtgtgttcctctgaatttagccatggctatctgatgatgtattgataccaagtcttcggaaatggctgtcaaattatgtatgatactagttgaattttgaattctttacttaatcactccacctatattgctctgaaggtttgttgtgggtaggtgagttgcaagaaaggtgtgagagttttctaactccaatacaaatgttgttgtctaatacgcaagtaatcgcaattgcgatgagtcctctcaaactacgcaatgacagttttggttatactacctataatcatggagataaaatgttcacaagaacctcttttacatgagttctgagtgaaattcagaacttgtctgttaattcagtaaaaaaaaaaaaagttcaaatgaacagggtgagacagagccttgagctgatctggtccctctccattgacagcagacagcaaacgtaagaggttgttgaatcgaaaaaagcttagctgtgtgagatatttgctgatgcaatgttactctgtcgtccacgcttcagagttctgagttcaacaagtcacatgataaaaaggacaggcacaacagaaaggaaaagggatagctacaaaacccatatgctgaatttgaactgcagatttaaacatggaatatacaaacaattcgattatcaccattaaatgttcttattacgattctttggttgggtgatagctaaaatacatcatggcagcttgtggaatgctttccacttgccaggatcaggacatatggataattggataagtttgagaagtctcatctcttcagaaactgcatcccaatatagttatgtttgatgttcagaaatcagaatgctactctttaattaaattcgacaagaaactcattatgttcagaactagtcggcaagagaacacctgcagcaatcactgtcaattagactttcagaagacgagtaacggtcaagtattttgttctttctgcaatctgaacatctttggctgcaataaatcattgcagcatgtagtaaattaactgatggtagtacaaacaacacaaatctgaaatcactggtgacaaacgaactgtaggtgccattgatttcattttgcatcagcaagagcatgagagtttatgcccggtccttcgagaacatacacagcaaccaacaagtactactgtactagcaatatataatttggtcttgaatggcacatgattcttctagtgataagctcgaatatagtttttattgacagcaatgtggaaacactgtcgaaaaagttggccggtgttggatgcaaagatggattcttgtaaatgcaaaatctgacctcttttttcttgccattgaaatgtacatggagggatcaagttccatgaactagagccatcagaaaataaagtttggcactacttctcccacttggactttgcccttttggtcagaatccctactctcttttagcttcatgaggaattctcttgggagtcctaactttcaatttaggcacaataaacacagatatgcattgcaagtttgcaatcacttgtttaagctttaaggagaatatttggcaatgataagatatttattgttattttattgtattattattattattattattattattattattattattattattattattattattattattattattattattatcatgccctgttccttttttcttttcaatgtctcattcaagaatcatataccatttggaccatgctaatgatgtcggtatatatagcccagtgatcatcggtacccagaccatcgaaacaaaacattcttcagttgatcttgagattaagtcactcctccatcccatctcaagaactgatcaaggaaaggaaaaaaaatggcactgaggagaataatcaaggagctcaaggaccttcagagggatccgccgacttcctgcagcgccggtgatacgcaaatctttgcattacatcctgaaaatcttcagatagaaatgttcagaaacaaaatcaagaagatctattgcattaaattttctcattgttgttgatgaattggtgaaaattcaatcagggcctgtgtctgatgacatgttccactggcaagcaacaatcatggggcccaatgacagcccctactctggaggagtgttcctggtgaccatccacttccctcctgactaccctttcaagcctccaaaggtatgtgctaactaagcaaacatcacttgtctatcataattcaatcaagattcaagaagttgatgaaacccaatcatgaaatgaaaaatgaagcgtctgattgactcattgattgggatcttgggagcaggtggcattcaagaccaaggtgttccatccaaacataaacagcaatggcaacatctgccttgacatcctcaaggaccagtggagcccagctctcaccatctccaaggtaattaacaacacaagaacaacatcatcatcagcagcagcattgtgaattggtaatgaactgatgatgattaatagtggatggtaactcactcataattggtgcaggttcttctgtcgatctgctcgctgctgacggacccgaacccggacgatccgctggtgccggagatcgctcatatgtgcaagactgatcgcctcagatacgaatccaccgcaagaggctggacgcagaagtacgccatgggctaagcttagctgcaagctagctaattgcagctgaaatggcaattggatttggatttggatgcaggggacaatcagtcaatcaccagcatgtcgattagaattcagaaatatagatcgtgccataaaaaaagatagtaataattcttgcttgcaattattaggattgttgttgcaaatctgaatcatcgttatcatctaacctataatcaaaaaccatcgtcttcttggtgaggaggaataataaaagtctgcgattttgacggaattattgttcgtcagaagtgaaattggaattattgttctttaaaagtgaaaatttttcactgacacaaccgacgctttggccgagtggttaaggcgtgtgcctgctaagtacatggggtttccccgcgagagttcgaatctctcaggcgtcgattaacttttttattttttttccaaccaactcgtaatatttttttatatatattttcactttctttcagaatccctacggttacttcgagacgatttttttggggggggattttgcgttacccttgtgtgaatcgaacgctaccacagcccaattgcgaacagtccagctgctggattgaaaaataaataaatataatacaacagctctcgatattataatccatgtgtttgtaactttgtgcttaaattttgcagcgacatcgagagctaaatttaatcttagaaaaacaaaaggaaggcctcaatcgggtcttttgaaatcaggggacaattgccaattaaccagttgagatatatatatcttggttccaggcacttccagctgagttttatttaacctggtgatcttctgagatgataggttttgactgattgttggtgacaaccacccaccaaattgcatccagtttaacaattttcaaacatgtacgcatgtatgatattgattctgctaggctgttgcatagatggcctttaaaaatgtaactggcaaagatacagaattccagcagattccacatattataatttacaaacaggcctctacttcaaagttcaaacatgctctccacaatctccagaaaaatcattatgttactagagctagatgttgactccaggtaaccattggaagttgagtaggccacttgtatgcaacaattggacaagtcagaagaacatcacagatcttgctccatttgcagaacagaatatgaaggggaaacataattttccattgaagtgaaataagaaggaaaagaataaactgagtgcgattacatcatgtctacttatgaaacagggataacaagaattttttttctcaaacacaggaaataccatctaggaaagttacctaattgccacgacttgtcagtcacacgagataatcacaaggcagaaaggagaaaatgaaacaaacggatcgctcattgcctcgacaaagaggccttgctgcagctgccagtaaactaggatccccggaccatgaatgctgtttcgctgaagcaagacgcaacaataataaagcctggcaacttcatcgttcttcttcttcgtcgtctactgatgattagatcacaaaatggagcacgcccccctttgcgcctttttcttcttcttcgccttgggtggctgcagcaccacctttattgccgcatcgaaaacgcccttgacgttctgcagatcaggggggggcaggatatctctgttagtatcttatatgttattgcacatttagcaaagaaatgggaagaaagcagtactagttgggtctttgagctgcattcgatgtagtatggggcgcctatttgctttcttagttcctctccctacaaaagtggcaattaaggaacaaaaaaatgatcaagatatggcaatgtagtccacaggagttgcaagtacatctctgatgctacagtaaataaggaattaaacaacccacaatgccacaactgtacctgagcagtggtgataggaacagcaccaggatggtccacaaaaaactgcttgtcatctcgaagatctgccagtgcaataaacaatgtgaaaaatgtaagtgggctacagttggatctttacaggtcgaaggggatattatctgtagaatgattggaatttaatttcataagacaggtagaaacaccagccaaaaaaaaaaagacaacaaaactgaatccatcatgacaatagcaaactgagggacaacgtgcaatgccacaaatctgtgagacagagtataactgttgcatgttgttgaaccaaagttgaatagtacaaaagtagaaccaaaagagcaaacagttcaaataggtttatcacaagaatttcttgcaagtactaaaaactatggctgattgatatactggtactatatatccatatttttcctcttttatagagcaccctgcttcatgtattatcactaaatgacgtcaccagtaccaagcattgacatcaaaagaacacacaccaaataaaatcgtatcaacctaaaaatcccatgccactacttccatccaaaatcaaaaccgaacttgtgacaggtacaaaagattagatttctcaaaatagagccttgcacggttcttaccaagctttgttcccacaaggatgataggcacaccaggtgcataatgcttcagctcaggtatccactgaaatataacaaagtttagaatcaacaagaagtaccataagtggagactaaaaaagtgaatcgagccacaaaaatgatcaaatcaagtatcaacataagacaatgacctatgaacataaatttatgagattattatcatcatctatcatctctaatgggtggaataatccattgaaggatgcatctaggcctgctctaaattttgtggagcctaattcccagcatggtaatagttttatcatcgaagaaggcaaaaacacaagaaaaatgccagaagcaacatatcattgcacagacgatctcaaattaaacatgaccaacaaacttctttagcgaaagaagaaaaaaagagcacatcaatattattaacagaaaatgaaagtgagtcccttgccttctttgaaacattctcatagctggccttgctgattagcgagaaggccagaaggaaaacatcagctccacgataactcagtggtctcagtctgttgtaatcctcctgacctgtggtattccgaaggaaaaacttaataacttggtagaagaaaacaagcatgcagaattagatagcagcgcaaccagattacctgcagtgtcccatagcccgaggttgacggtgttaccatcaaccacgacgttggcactgaagttgtcaaacaccgtcggaacataatcctgtcaaaagcaatgacgcgaacaatgagtgcacatatcgtctcaaggcacaaccgattcataagatacaaaatgaggtgaatcctactgttacagaactgataagatatctatggtaaatgtgcagtccattctcaaactcttgcctaaagataagattacaaaactgatatatactccactagattactattttaccaggcctattatacatggcaagaagtccacaggtggtccaatggatacactacccccactacatggtcaccatgtctcagggctctaataagctaatctaccccccaaagcagctgaaatgttctcttcttttgaagatctctcctcaaaagagggaaattaatgtgcaattgggaaattaaccatgcgcgaaaagcaagggtggtggtgtgtaattgattgggtgtggatttgcgtgaaaggaacaaagaatgcgcttaccaaccatggggaaggtgtgagatgtgagtggaggagggtacaggacaactagaaagtcgggaaagcgatatcgagctctcgacctggcggatccgcggtttcccacctttgatagagaaacgccagccaaactgattcgacgttatatgaatcgtggggggaaaaaacctgcatttttttccgccgctaatgctgctacaatccataaatgctgcaagcaatcaaggacgaattttttgtttttctactgcattttttttgtttgagcgttcacgaggaacgaatgaggcagcatttggcttcgatttgagccacggtttttgatttggtacggggtgccgtgcaaaagatcccctttttactcaaactcgaatggcaaccctaggcaggaattcgaagccgcattgtcccaaattcacgagcggcggacgaatcagaaaagccccacaatttgggcccaaatccagatcaagaaccataatcctagctccaagcctccgagcacacaagtattttttttcaaaaataattaaaaaaagaagaagcaaaagaaagaagaagaagaagaaaaggaaatgtttggaggaagaagaagaagaagaagaagaagaatacgcacagtggggaaggtgttggaggtgtaggagatgagcatgcaggtcttgccgacggcgccgtccccgacggtgacgcactttatgaacctggacgcgctcatcctcgccgctccccgtcggtcgcagcagacgccgccgtcctcctcctcctgcgaccgctcccccctctctctctctctctctctctctctcaagaaactccaagaaagaagaaggttgaaggaggagcaaagcaaggggtcgacgcgagaggaaggggggaggttgggttaagattgggaggtggaggaggcgaggcggagagggtttctcgcagatcggcgggtgaagcggtctcctctccgcgccgaaatggtgggtggccaagcgcaagcgaagcaatagcaatgccccccaatgcaaatgcaatgccgagacccgagacaaggaaggagagagctcgctcgagacggaggaggagaagaggaggagtagagagagaggtggtgggtgaggtgggtggaggaggtggccacgttgtgcgcgcgcatcatttccttctttattaccgctcctccccgattatcacgcacgcatatgcccattaattatttctttttctcgccccccccccccccctatcattttgtagtatattagttgttctatagttagggcgaaaattcaatcttctttagtagtaattctaaactcatgtaatatgataatgaataaattatttgggttcaaaatatcgatcaattgttgtttacattgtagcaaccaaccaacgccgatcaaatgttagcgcggctgactgggtggctactataacacggtaagccataccgatcagggtcatcattaattcgagaaagaaattatatcctttcaattaattaaaaagtcatgcacgataatataagtatcttgaaataaatgattttggttcaaaatatcaaccattatggatgtaaattgttgccactacagctacaaaccaatatagattaatactgcaccagtggctaccgagcacatatgtagccaacaatattcattaggactgaatatagcttttatatttttctcgtttattcaaagctttgtttgggacattgtaaaattttacaggattttcatatgagtcaatttttttcattaatatcctttgtttcagtttcccatggagaccatattacttgctaatgtgacagtactactacggagtatataccaattgcaattggtagttgtgtagttaattccagctcacctgtgtacaaactgtcaaatggtaccagtgtactgtagcttttacagatgttatataccggtggttgatgacttgatgccattgtcctaacctggtgtactcgttacattgtcctaaccctgtctgtcaggccgagaaacatatatatgtgcacatatatgtagtactatcatactccctccgtaaaaaaaaaaaaaaaaaaaaagaccaaaccctggatttctgtatccaatgtttgaccgtccgttttatttgtttcaaatataaaaaatattaaaaagaaaagtcacgcataaagtattaattatgtttcatcgtctaacaacaatgaaaatactaattataaaaaaatttcatataaaacagacagtcacacattagacatgaaaacctagggtttgtcttttttttttttggacgaagggagtatgtcaaactcaagcttccaaaaccatgggaatgggtgatcataaataaataaatgtcaatttcatactattgtaatttttatcatgtgttacaatcatcatattataataaaaatagttgtattataaaaggacgatttgttatccctatcgggttgctatttggattttaaaactggtccatacaccgaccttttacgtcaagaaaagtttttaagaaggcattcacaaccgccctgaccttatttatgtcatttctttcttctttttgatgattggatttattatttttatcattttacgctttacctactttgttcttttatattttgtgcctaccatctgcccaaactgcaccatccattattgccttatttgtgtctttttcttctcggcgtttttgccaactcagtaatcaactgctcagcagtcattcattgtttttttggcacaaatttattcagtatatatacagaagaagatgctgtaagttcaactaacaaaagttgctgaaaaacctttagaggaaaagtgaaattgttagttggaagataatacttctacatcaagtgaagtgaagttgatgcatctcatatgttgggcaagaaatatgatttctatttcagctctctttggtcatattataagttctaagattgatacatcgaagaaaaatatcaaactgtcctgcattgaaatgcaagtattatatgatttgtgatagaattggacaaattgacatgacaaacttttcttataaaagaaatgttacacgaccaaattccatccagctatgagtagtcaccagttggcaagaaccaaaacaaaaccatgagtgcagtgtaccatacataaaatagtattgacagctaataaaatccaggatccaactggctggattagattggggcagttgtttgtttctttccctctactgtgcagtcacaatgaccagaaggcagaagcatccaccactcattgtacccaatcaaattatggaaacaaatatactgctaactgatcagatggatggatggttcatccaagcttactggcatcccaattttgcctcattaccaaatacaacgaaaaggttattgttgctggtatcaagccaggaaaaacataccatggtcaaaatttatttttatgactattgttgtggttacctggtccagcaaaaggcacacgaaaaggttgagcaaaacccttatctggtaggctacagcaaaggttaagtacacatccattttttttaatggatattcatccgttttttaccatagggttgcacagttatttgaatttgtgtatccttttagctgactcaagtgtgttcgacaaaagcatcgcaattgtcattggcccgacaccaccaggaactggcgtgattagtcctgcaatcttggaggcctcctcgtagcacacatctccaaccagccgataacctcgagggctttctggatcctgagacatttcaaatcactagtaagcatagcatgcaaggaaatcaggaagggggtgtagggaaagaagcagccaagtcaccaatttctttggaaccttctgaggtattaactgagttaggatacaaaaacatacaacaaaacttaaagatatgcacaagccaacatttaagtgaaggcttgtactaaattgattaatcatcacatattgcccaaacacatatacaatgtgaagaaatttaccagcaaagatatgggatcatcaaaatttaataaggcaatttaagtttttataaatgggtgtccaacagtgggatcacaggagggtctactggtgtagttccttacctgccttcgatcccagctgcgaggatctagacaataatgttccctttgttcttgaaaaaaaaaactatattccttctaagaatgtgacattttgcatatatgaaccaaacatgattagaaacatgaagtgcaaaagcattatatattattttattaacaacacaaatacaccattagccatctggatcccaccaatgtggtgatattccagggaaccagtaacattggaaatcttattagcaggttcaaactacctccgtcccaaaatataagggactttggctatgacatgcccagttttcatgcataaaacttatccatctagaaatgggttggcattaaaagcaaacagatctgttgaatgttagggaggaagaattaaggaagccaatcagaaaagtaggtgtcttacatcaactggattgatgccaacatcaataatagcagcaccaggctttatccaactccctctgaccagattagcaactccaacagctgcgataacaatatctgcttgtcttgttatttcctcaggcttcttggtatttgaatgtacaatgctaacagttgcgttggctttctagtaatcacatatggcataaaaacatgttaattaaacactccaataaaatttctccaactaattgaagtgagaattaattcatacttgcagtaataatgcagcaggcatccccacaatattgctccgcccaattacaacagctctcttccctttgatttcaactccatatctgtgtagtaattccatgcatcctttaggggtgcatggaacaaagaacggatcccgaccttgcattgcaagtcgtccaatgttcagtggatgaaatccatcaacatccttctcaatactaacagcattcaaaatgttctcatcattcatatgctgcaaaccatcagagagcagaaatacagatgctcagtggatggaagacatggaaaacttgtgtgatgctagcaggcaaatacctcttttaatgctaacaggtaaaatcattcaaagtatcttgatcaaaaaattattcaaaaatatccccatcattaatatgctacaaacaatgcaacaagattaacagagaactgcaagcaccagtatagaccatctaattaaaaacaaatgctgacaacaaactcgaaagaccacaaagggaatgcgacggactacctaaaacaaaggatctgtttgcacacatttttctaagaccagatatctttcacaagagcagcatcaaaccagttaacataaatagaaacatttagtgtacaaattggagatggcaccaatatcacaatatttccagaaaatattgtgcataaagtaatgtttccatggtgtgccatactgccatacatatctaggaatgtacctcactaaaaatacatttaactaccagttcagttggtaagggccaaaattcaatatcagtggataggttatacagagacattggcccaaagaaaattgttgaaaacttacatgaggtaggggcaactgaaccaagatgccatgcaccgacggatcactgttaaatgttgcgatgtgcttgagaacctcatcctcagagctgtcttccggcaaattaacctcatatgacttgataccaaccgcttcgcatgccttcttcttgttgcgcacatacgtttgagaatccttccttgacccaactaggatgactgccagcccaggcacaaccccaattgcatccttcatcttggcgatctcaacagcgatttcctctcttatctgctttgccaccaacttcccatcaatgatcttggcacaagcatctgatgaacacagttgtaacacatgcaaaacgattaaaaaaaagaattgtcatatcagtgcatcagaaaatacaaggatctcttcatatactccatttgcaactacacttgctcaacaacgaaatcaaaaacatagtactatctaataatacaggtgcaactaatagcaaatgggtttcacctgaagagctcttccagccacacacaactcgacacggatgaatagaacattcacagtcaggcaagcgaggagaagtgggcgcgcgcacctgagtcggtagaggaggcggcggcggcggcggcggctgaggccgaagccgtgccgcgcgcgcgggggagaagcgggagctggggggcggcgatggcgaggggcctccgcggcggcgcggcgacggtggccgggcggaagcggcacggcggcgcgaggagggcgcggcggagggggaggaggcgggaggtggcggaggaggagcagtcggagagtatggaggacgccatggctagggtttagtgccctggagcggcggcggcgggaggtttttcgcgggcgcacgggaagggaaaagaaggggggaaaaagaagagcggaaaaaaaatggcgtgtaaatgcagcagccgctaaaccccacgtaacaacaagggtttagggctaatccattaataataaaagattttttagggtctaatcaataattaaaaagggattatttattgatttactactccctcaaaataagtgcaacttttggggtaatatttattgtaactactatgtaactgcactgtaactacattatcatctccgtataatttagatataatgttacatatattattttattacttatataggagttacattatagttatagtaaaattatattgcaattatactataagttagatttgaaagttttctttttaaaaaactttcgacaattctctagatagtccctttagctaaattttaggcccatttggaatagtggaaggctggaagatatgtgcaacttttaggctgtgttcgcttccctcgttttctgcgcgcatgcttttcaaactgcttctctagttttctagctaaaacttaattaatcatgcgctaaacgctgcttcgttttgtgtaccagagagtgactcccgagcacagccaaagagggtgcgtgctccagttgtttcctcggtttcaaaatcaaaatgttgttttgaacaaattttggaggacaagtggatatctaacactccttgtaacgatgccattaaacgagtacatgatcttgcaaagatagtcacaaagatgtagagaattcaggctatgttctactgttctcagaaatatttggattcagcaactgaaaaagacaagcagcatcacctcgtaacctttgccatccaatccaattcaaatcgacaattacagaacagctaagcaaaattccgctttattaactacagaaaaccgaaactatagtttcctcacaactgtagaaatgggtagtaaaatggaacatatcctatgctttatagtggagtattacagaaaacaaaaactctccctgattgatctgaatcttgcagcctatcgagaagcaggaacggcagtttcagctggggactcttgctcctgtaccagtgactcccactccacctccttcaggattctgaacctctcgtcgagatttacgaaaccggattgctgagtgaccgctccacaggtgccggctttgtgtatgaggactacggtgccgcccatgtcaggcccatgaagcttgccagtcagcagtacacggagcggcataaagagtgactttccctggtcacaaatggatacagccagaagaggtaagttataattgttccattcaggatatatggcacaaaaggcatttgcaacaatgggcttgaatgtgattttaaggtgaatatgatggttagtatatacaagtcaaaacaaaggaagcttactagggttgggttgtcaaagtctagatcaaatgattcggttgtattttcatcatttctagatatcaaggtttaggtgagacagattgcttccataaaaagttgtgtttgagcggcacctaagaacaaaagaacaaaatgattgctgtcattactcattagcactgacctttcttttaagtgatttgccaaaaattttcacccacttctgccaaccatcacggccctcagctagtgcttgacaaagttcaccgctatcataagcagaaatgagtcctgatgcaacctcagaaagcttgtcttgcaccacagatttagcttcatcactggtaatttacatgtgaacagaaaaacgaactgtttactccaacagtactaccacaacaaccaattcactgaagaaactttccttttttggcgacaatttatgaagggactttcagtgaaagattaatgaagggttcccgagggattaaatttaaaacatcacatttctgcagacctgcttaatgtagcatggaggggatacgacaacaggtttgaaagggctgcgtcagcatcagtgatcaaatcgatgccatccttcaaaagctcagccgcttcctgtgcaaaaaataaagtaattatgttattagtgctccccaatcagttaccgtccatttagcatatatacctaattctttttagtgtgtagttccaaagtacaaacacccatggtgtgtagaaataacaaaaggcctccaatcttactttagcaaaaccactttcagactcctggagaatgcctgtgtccttccatctatcctcaaaactcttgatgagtacatcagggggaaatgatcttagatgttgtccattcatccatctacaaatataaaaagtaatgcattatgtaaataggattgtttgtttattttccatgatcaccagttcaagtgagtagttgtgtgcacatgcacttcttaaaggcaacggtggattagataggccaacaaaatatcagtaggtttgagcttgatggtggtttctgagggtaggtcccagtaaacaagctttatcatgatggaatgcgcctttcaaacactactgaccagcaggcagcaaagtacataaatacgtatttattactgattagacacactgcatttattgcttatcagacttatgtttctctttgatccataatgtggagtgattttgcgaactccatacagtatatcaaatccattgatacactgtacatttaactttgttggtcatatggagttatggactggacatgcttcccagcttgtgtctgagttcataaataaaagaacctatgaattactagctacttcctccatcccaaaaaaaacaaatccattgatacactgtacatttaactttgttggtcatatagagttatggacacattctagtacaacgaatctggacagatatatgtccggatttgtagtactagcatgtgtcatatccagtactagattggtttttaagattcaccttctaaaatataccaacaattagtataatatgaattaaaattttattagtgaatattatcattggattgacatttgaatttaatttcatatggttataattttgttgctacaaaccttatagtatatcagaaattataagcaaaagattatttttggagatcgtgacgtgtttgacgtgcgatagagggagtagtgacaatgacttttcactggttcccttataattgaaataatgcctgatatcagactaaagaaacataacaataagtggaagcaagctccagttcaactaattatagtactgcaactgagatatcacgagtaattagagaatactgacaaattctatgaagataactcaaccagaaggagattggcaaaaaaaaatgatcttactttaattttacagcatcaaagactgctccacttttgttgacacgatttatagtgaatttttccactggaaatgagatataacagcaaagaatgggtaaatggatggtgactgtaattttcaaaaactgtgcagggaaagtaactgaacgaattattcataaactaacctaggtcatcaatggtgaagaactcattttcagtaccatcaccccaaccaagaagtgccaaataatttaccattgcctgaggcaaatagcccatctctttgtactggccaaagaaaagaggacacattgttacatttttctaacattgaaagtgtttcagaaaagatgtgaaatggcgagtaattagctgcaatactatattttgccaaaatctagttggttacctgtcccacagaagtagccccatgacgtttagacagtttacttctatcaggagctagaataagtgatacatgagcaaacgaaggcattggaaatccaagtgcctgcagaagacagtcataggacagtaggcatattatgttgagacatacagttcgaagggtcaaggttgtaaacaatgatacacaagataagaatggcatagaaaattactttataaataagagcctgccgtaatgtgtttggcagatgttcttcagctctgggggagaaacaagaggattgcaaacttcaggaagaaatcatcaaaaggaaagataacaaaataattagtttacattacctgataacatgagagatgcgcatggtagcatcatcaactgtgacacagaagttatacactggctggccattgcttctcataatcacgaaatcaccaagcgtgtctaagttccaactgacctttataaaactatccgatgcttagtgtgtgtgtatcacttctcataatttgcaagcatgaattattgacagtggaaggctaaaaaaaatgcaacgatgtggcagtgctagagtttctagttattacctcaccacgaataaggtcattaattttcaacgacccttccttcggtacacggaaacggtaagtgtaaggtgtccccttctctaactcctgttgtatttctgcatctgaagcagtcccccacttgcccatgtatacaggtggaagttgcatctgctttgcagtttctttcatctgttcaagttcctgaagtaacagaaacagctatcaaatgggcaaatagttgatccagtagaattccagaagtaacctagacaaattgctgacggggtttaaactaactcatcccttagtattcatagttgaataaatcactacgagtgtttcatatgaacacacagaaagatcaagcttttttttttgaaaagcaccaaaataatactccaacattacaacaacctgtgtataagcgcaacacaatgcatcacacatacatgcagatcatgcaaggggagaaatatacctcactggagcaaaagcactgatagactgcaccagactccatcagcttctcggcatactgtttgtacatcgaattgcgctcggactggcgatacggcccaaattccccaccaacatcgggacctaagcaagtacaaatatgagcattcatatcatctaccatcatagaggaaaaagaataactatttcactggtttatccatgcttaataaaaccaaatacacatctccacagttgcacaatatcaataaagataagcaatcagattgtatcaatcagataatcataagaattgagcttgccagaactctcgagtagagtagaattcagcatccaaggcctaactacggtggacagcaatagagcactacatcaaaatgatactccctccgtttcaaaatgtttgacaccgttgactttttagcacatgtttgaccgttcgtcttattaaaaaaattatgaaatatgtaaaactatatgtgtacatgaaagtatatttaagagaaaagtgcataggcggtccttaaacttataaggttgtgtcatctaggtccccaaactctcaaaatgcacatctaggttccagaacttgtcaaagtgtatcatttaggtcccaaatcgacatagcccctatagaatcctatgtggcgctgatatggcatgccatatggacgtgatatgtccttttcttcctttttcccttcttttttcttcgttttcttctcattcttctttttttttcctttcttctactcgggaaaagaaaaaaaaggagaagaaagaaaaaaaagaggaggaggaaaagataagaaaagaagaaaaagataaatgggtttcatttgttagtcaaaatgatgccacgtcttgtccgtgtggcatgccacatcagtgccacgtaggatcctataggggctggggcgatttgggacctaaataacacactatgacaagttctcggacttggatatgtattttgagagtttagagacctagatgacatacccctgcaagtttaaggaccgcccgtgcactttactctatatttaacaatgaatcaaatgatatgaaaagaataaataattacttaaattttttgaataagacgaatgatgaaacacgtaaaaaaaagtcaacggtgtcaaacattttgaaacggagggagtacaacttaacttcctaggcagtaaaacattagagcgatatagagaaatcaggtgggtcaactcaccttcgtcccagtcaaggccgagccaggcgaggtcactgagcacggcctcctcggacttcttggtggacctctcgaggtcggtgtcctcgatgcggagcacgaacttgccccccttggaccgcgcgaagaggtagttgaagagcgcggtgcgggcgccgccgacgtggaggttgcccgtcggcgacggcgcgaagcggacccgcaccgggccgccggcgccgtccggtgacgccgaggcggaggcggaggcgcggacggagagggtccggcggaggtggggccgcaggaggcgcggcggcacctccgggagcagcctgatgcgcagccatggcgaccccattgccgccgccatcatctccggagattgggagtttgttgcgagaagaaaaggaagaagaagaagaagaagatgacgatgcggatagagtttggggatatttgggggcccaacaaagcccacgcgcttacaaactgcagtagcccaacaaccacgaaggaagagagactgacaggtgggacccacaaagcagtgtcttgtgaggcattttatccctcagagcgttttaatccagcaaaatgcggagttggaaagttgcttgcaaagtagagataagagaaattaatctctttgatcttgtgaaaagaaaagaaaagaatatactcaggtggcgtttggatacatcggatgtttggatattaatttaaagtattaaacataaactacttataacactaattatataaatggtgctaattcgcaggacaaattttttaattctaataatccataattagcacatgtttattatagcatcacatagactaatcatagattaattaggctcaatagattcgtctcgcggattagttcagggttatggaataggttttgtcaatagtctacatttaatacttctaattagtgtctaaatattttagtcccatctaaacagccccccaatccattaaaaaaagaataaaccttttatcgttcgtcttattaaaaaatattttatgattagcaggtttgttgttattagatgataaaacatgaatactattttatatatgactgtttaaaaaatcataaacatatgtcaaacgttaaacatagaaactgacgtatgcactttctttaaataggacggaggtagaaggaaaaaataggttaagagcatcaccaacagtctacctatatgatttccaaaactaattttaagagattttagtccaaaaatcagcttcaacagatcccctactctcctaccaagttttggagtttccttctcccggttcctcgctccgtttatatgcgggtgcgaaagtcgctcccaatcacacaatcctgcctctctccttcgttcccgtaaaaaaacagaattttctcttggtagtttaacagaagggtccacttttaagttttggggattaaatttaggctatccattggagggaggagttttttcactttctatttttaatttagaaaaaaaataaatttttagaagaaaattatagataatctgttggtgatgctataagaggatgaaatggtgaggacatggctccaccagcccaccggccaaaacaacgagggcaaggaaatgcataattgcacatgatggatggatggatggatggatgagacgatgcatgggcggccgacgacgaccctgcccagtcttttgttgtgttgtgtgcgttgtttgatccttcgtctgcaccctgccctgcccttgctctgctccgtctcgtctcgtctcgtctttggtattggcctttgtagcatcactgtagtaaattatggattaatatatctcgttagattaatctcgcaaaatagactaaaagttataaaataagttttgtcagtaatctatgtttaatactcttgaataataaaattttggagcactttaatcctagcgtgaagcatccaaacagggccattgttgctgctgccttttcttcccccagccaggtcaggcctgcaccccccccccccccctctttcgtacctaacgacaaacaactcctctatgctcctcccgcctccacgtgtaaaacccgctcaatctacactagtatattcataatactatcacattcgttaaaatcttttatatcatggggaagatgaagcactgaagtgagtagattttgacaaaagatagataaagatgaagatgaaatcagaacacgcaaggtagatgaaaaagtcatcggtatatttttttaaaggaaaagtcatcggtatatgattaattaagtttaattattatacaaactttatatatatatataatagacacatcgtttaacagattaaaaaacacgtgctaacagaaattgagataaaatttgaatcttaaccagaagagaatgaagaacggaccacaggcacaatagtatttagattctaagttatctaattttgagtcgatgatacgtgaatcatttttttttgagaaccttattgattctaaaatccacattgaaaacaagtcaagtctatagctagtgggtttaatttctacatagatgctacaactatgacaaagtttagcttaattagcactcaactagcacaggaatacatatacatatataggagtatccacggtcgtactagcccacagcaaatagtaaattctccccacagcaataggcaggggaatcatacataggagtataaaggtaaaccaccagttgagctgcgatcaggattacagtatatgagcgagaatataatctgttggctccttcggcgagaatcattcaattcacaaggataatgatgatgacattcagcatccatatcgatctcgctgttcaaaaaaagctccacaacgatacgattcgccacaaaaattatgcttacgcgcaacacaaaaagacaagctaccccctctataggtgcgccatccctccatcccgaatcattgccttctttcgtccacaacgcggaaaatattacagaatttacaacgcggagaatttaatcttgccgaatctaatctaactgtaaaattactaacagctctattttttcgcttatacttatcagctaaaatttaattttcgaaccttaaatttggagttgattttatggtttttcatcgaagtttatttttcagccttttcttttagatcgttaagaacacgtatataaaagttttatttgtaaattatttttcgtttgcaaatttgttcagcctaagttttagagctcatttggggcgtaggattcttttacgacgcggagaattttctacatcctccggaatctgaaactagtccctgtaaagtttctgtgttttatgacttgtttgacatacagtactctcaaaatgaagcaaaaaagggataagaatatatcatcagagtatgcaataatataggatttaaaaacaaatgaatgctgaggtaaatatgtttggatggttacgcaaaatagtactccctccgtcccattataagtgcagtgataagtttctgtgtccaacgtttgaccgtccgttttatttgaaaaatttatgaaagatttttaaagttaagtcgcgcataaaatactattcatattttatcatctaaaaataataaaaatactaatcataaaaatatttcaaataatacggatggtcaatgttggacactgaaactcacaactacgcttattatggtacggagggagtacatatgattcttgtaggaaaatatttgcaactttctagtaacatatatgcagaagacaatagagacggaaaggtaggccacattttatctgttttcctttttattttccagatttttgtcctaggttatttggtaaacgcttctagaaaaacttatcaaaaataatttctcatattgcattgttaatttctcctaggacaaagtttctttcataaaaacattgatttaacacgctaatcaagcaatctgcctcaacaatccacataaaaatctgttcaaaaaggaccttggtgtgcattggacttgtcaaaggacaataatagaatactaagaggtaatgagctcatgttaaaattccaacgaaatgaaggtatgtcagaataattttgccattatatttcttgttccaaacaatcctggcccaatttgatggatcttatatgaacatttaaaacacgagaatttaaaaaatgaaaaacacataagtagaatggcatgtcagtgcaatcctatggaatatcaaaatataagaattactccctttgtattgttttgataccacataagaaaatactcctattacagaaatttggagagagaggatgacttttggtgaagtttctcaatgctctaccttttgataaacatttattgtgagcagcaaaccgttttagatgtggttaccgtcatcctatagtcaaaatcacttatattttgagacagagggagtattacagaaatttggcgaaagaggatggctttttggtaaagtttctcaatgctctaccttttaataaaaagttattgtgagtagggtttaccaaactgttttagatagggttaccgtcatcctatgatttggcagtcaccataaaaatcacgcagttattgtgatatatactccactagagagagttaccgcaagtaataatcacgaaatcttacggtttggtaaaccttgattgtaagtcaacgtagtcaagcgaaaccctgggtgcaagataagagatggacgtggcaatggcaggactgctcctgtgaggatggatgtggcaccagggacagtgagtgcagatgctgatgatcagaagagagagtgtccatgtggagggctggccggccttggagcaaaggaaaggatgagacgacggcaacaaaagcaggagagagggagtgtctctgacagagtgacagataggaaagggtcccatggctgctgctgccttcaggtatccgcacatgtctctctgacacgcaccaccaccccccacacagccaccccaaagattattttagaaaaaataaaaaattaaaaaaaaacttctctttctcctccagtactactcgtgctactactggtagaggagtaaaataaacgtacactcgtctactgctgcatctgctgcctgtcttcgcttttggatcccatcaactgaactgttgggcatatgaacacatgccttcttgcctgcctactgtccactccaccccctactgctgtcaaaacaaaaacaataatctggagtaattgctgattagcacatcaaactatgcagctttcaagtttcaactcccatgctttcttcttttgatcagaaaactgagtggatgttttggatggagtctaactttgtcataactcgatttgccataactgtggcaagccacacaaagtgtgaccaataatttgttggccacaactatgacaaactttagctagcaaatgagagtatgacgcgtgggccaatgtgctaataaaatatggattgactcaactgcggcacgcaaccaaacactagcctgaaaaattgtgacacgcctaaggtttggtgtggtaaaccgagaccaccaaccaaacagcccctgaggctttacccacaaggttattattgttgttaattcaggatttaaatattaacggataccttttgtctggctaccaggccaagtggactacctgcggaactactgaatcaaaaaaattaaaatcactccgagcttctgccacggcttaaataatgaataattttggatcataaatgtcaccttctgccacggcttaaataatgaaacattttggatcctaaatgtcaccatgttagaccatgtgtggcaaatcaacaattccagcagtaaacaattttggcccaaaccatcaaaatgacactagtagtacaatcaatctttttggttaactaaaacaggcatggataggagtaccagacaagtcctgcaataaatccagccgctgcccacccacaacattagaacaaccgcaatagtaaagtaagttgctctctataacacatctacatctcagcaatagactagattaataataaacctccttaatagtatgtctacatgggtatctatagctctctaatccattgcctcgtttttctcgttagtagatagctttgctatctctctttatttaatctcttttaagtagaaaaaaatgctgacatagatatcttgtagatagtatatagataatcattgcgggtgcccttagtactactactgtactagtagatggcaaaatggcactactgtaattttgctaccggttagtacatcttaacattggattgtattcatgatgatgcattaagggagatgatgcacgcagcagagtccgatttggtcaacaagaataattcttctttgcttaaatccatcaaccatggatcttcttttgtactagtagtaccattgatgaactacagtgattgttgcttaaggatggagctaaactggatacaccatgatccgagatcaccaccagatcaaggacaacaaagctactcctactagccaacaaaagaaatccaaaacaacaccagacacaacatgacacccaaggctcagggaactgacaatagtgtcaccccccagattcccagatgcagcaaagctactactcctgtactgtagtactactctcctccctaactactcagaaaacaaaaaaaaaagataatccattgtatgccaaagataatccattgtatgccactgagtttgtcataggtctacaatttaccactgactttgtcacgttctataatatgccatcgatttttgcttaacttctacgatttaccaccgccatccggttagtctccgttagtactgtacactttcatccaaatgaccaaaatacccctgagacaaaaactttcaaattttggataaaaattctgaaatgtcagactttaagtttttgga

SEQ ID NO: 69636 - DNA, 1409 bp, Oryza sativa
gatggtaaatcatagaaggtaactaaaagtcgatggtatattatagaacgtgacaaagacaggggcaaatcgtagagctatgacaaactcagtggcatataatggattgtctcaaaaaaaaaaaaagtcactgttgtacacaaacaggatgaatgcaacatcttattgatcctaatcaagtcaagcaaccaagatcaagctggatgcaacatcttattgattctaatcaagtcaagcaaccaagatcattagtagtactatcatgtatacaagtaccatcattattaggagtaattggcagcaaatctgtggtattgttagcagtatcatgcaagcatccaggacagagagaatattgatcatatgctgatgatggaatcgacaaggtggtaaaaattatagagtaaccgacaataatcatctttttcatctcggggaaaccacaaaaaggagagagattttgtcaatctcctcgcccaacacacaaaaccaatccagacatcacgtcttcttaacctgaaccagaggaccagaccaactcatagcagcaaaagcatcatcacacgagcagcagcagcagaagttaaaactaaaccgaaatcccaatagcaaaaaaagaaaaagaggtaaaaacaaaaggcaagcggttcctttatagcaggcaacgcgctctccatgtgacccagatcggcggcaaaactaaagcaataattcgacttaggagtgatgaagatttaggcgagatctaagaggaggggggggggagatggtgttgtgaatccatcacttgtggcagtcgcgggcgatgtgtccagcctcgccgcagttgtagcaggagcggtcgcctccaccgccgaatcgcccgcctccgcctccaccgccgccgttgtagcagtccctcgcgaggtggccggtctcgccgcagttgtagcaggcgccgccgccgccgccgccaccaccaccacctccaccaccaccgctgttgaagcagtccctagccatgtggcccatctcgccgcacttgaagcagccaccaccagcgccgccgccgccgccaccgcctccaccaacgccgacaccgccgccgttgaagcagtccctggccatgtggccagactccccacacttgaagcagcccccaccgggtccaccaccgccggatctcctccccccgccccagctaccgccatagctgcggccgccaccgccagatccgcccccaccgcgcgatccgaagcctcccccgccaccgccgccgccgccggcgccgcccttgacgaaggatccgtcggggccggtgacgtcgacggccttggtgcggccgtcctcgctctcggagatggcgaactcgacctgctcgccctcggcgagggagcggaagccgtcggccttgatggaggactggtgga

SEQ ID NO: 69637 - DNA, 13290 bp, Oryza sativa
ttcattgcgtgcgtgattatgtgcgtacgctcgtgtgttgcgtcagcgtgtaccaccacgtaacagagtttcatgcctactactccagtttagaggtgcaatggatacaataccggttaccgctgggttttcttaccccgtatcatctccaaccatacctattcgaaacagtatcctcccacatagtcactgatatatggatccgtgaacggtgaggctcacatgtcaattaccatgtccttctgactccatgttagaaaatcgcaatcccacctatccgtaggtacaagattctctctatactgtatatgtgcgggcaataactacccgttgcaggtcggactcaggtttaaccaaggtcttaggctaactcaatgcatgttgagccaagacatgtctttttacatttgtgaaaatgcatggtttatatggggttttaggcctaggtccgacccatggcctaagtggctcatgacctaggtctgtcattgacctgccgggtaccgatacacgtgacactttgagcacttgcaatttacactatagtcaaatgattagcaatcatccattaacatcataatgtcaggtatacaatgattttaacatcaaagttagcaaataaacagaccaaacaactacattccaaaatcaagaaattaaatgataatgccatacaacagactagggaagaggttgagaggttaaaggagttttatcgaatgtccccgaagagacaggttaaaggagttgggagtagctatatttatggcgccatatttttcaccaaaaaatagtcggcatgtatttatattgtaagtttctaaaatatatatgtaattttagtgcatttacaatgtaaatctcgaaattacatatgtaattttagtgtatttataatgtaagtaccaaaattacatatgtaagtttctaaattacacatgtgtaattactgtgtaaatagactaattgcattctttgatgaccaacacgtgtcacgcaaagcaaaaaggagtcaccaacttaggagcaagttgttcgattagcttatcagatgtactttacatgaatcgtgaagaaaattagatggtagatcgacaaactgactgtatttagcctagaaatatgtcgacataattttagcaaagccgaaggagttttatgctacagatgataactattggcagtttttctatgcatacggtttttttaaccatggattagtgggtgtggatggctaaagaataaacccgtagagtatatccaatactcctcattactataccatatggatataacaattttttctcactagtaaaaaactgttgggtacttgggtctccaaacgcggaccctcgtcgccgtatctactccagacaatgcttatacaagcttttaagaagatgttttcaccttgatatttatgttttcaagtccttaaatttcctttgcctggtgattttgacttgtctcgtcacaaagcaaaagagcagcaaaaatggaatatgttttcaagcccttaaatttctttctcgtgatttaaacttgtttcgtcacaaagcgaaagagcagcaaacatggaaaatatatcgcctcaaaggcacaaaaacactcttaaagaccatcagcctaaaccttgaacttttctcacatcgataccatagaagtttacagttaacacccagttcatcacagaattgagaggcaatgaacacagctgttgcaacttgcaagagacggttggtatacaatcatccagacatccagtacagaccatgcagtgtatttctacggatattttgagcacagcttcaggcatctacaaacatctcacagccagtgacacaaaagcagttcttcattgtgggtgtcactgcagaatctggaaaaggaagaatctcacacggcgagtcgttttccaatttcggataagcagcgaaggcaacatttaacgttactttccccgccaaaaaaaaaaaaaacatttaacgttacttgtaaccaagcaccgtgacagcgtatagcttgcttgtccaggggtgaatgcccacaccagcaagcaaaagatgggcgacaagaattcctgcagcggaagcagcttttcatcacagctcagcacctgtgatctctgtggctaccggccaaggccatggtccatggctgcctcatgattgccaaacattaggctgattagggttcatgattaagtccctaatgatggcctttaactaccgtgccttgctgaggaattccatctttaatgtgtcctctagttgtgagaatgtcgatgagaagatacctgaaaacaaaagaacagtacttttttgtcattgtcaccgagataaaagaaaaactctaattttgtgcatgtactagtaagccagaggagctatcatgcaattggtacaagtatcatacatgcagaagttctgtttggttcacatccagttgcaaccactattggttatacataatacaattggaatttgagggaatgagctaaatgctcatgctgcacatgtatagactagagatgaacagagcaattatataacctaaccaggtttgaaatatgacaagcaatctctatttaacagaaagatcagctagagattcttgtctgcttgtcctactatctatagagcttgatttacttccctctacaacctgaataattgtatcctcaattgcaaggacggtcagtcgacagtcaataacaaaagcagcagcttcaatgccaacatgccatatgatccgtatctacaggctctgcctcctgcaaacttaccagccaaactctctcaatgcgtcaatggtccctagcgttcaagtgtcatttaggagtatgtctccatcgtggaattagcactagcagctgtctagagccagtgacaattcatatgctagagccagctaggcatcagtactactgtcacccttcttttactggatagacaaccaagacaattctcaggaccgtttcatgactataggaccaacacagcttggcagaggagggcatgaacaggattctccatctcgtgctgtacaatgtacatttgacaccatttggtggatcaaaattttctactcgatcaacagatttcattatgattgagcgtttatgcactgtaaaacaacctcacatctacaaaagcaagtgccaatcatcctgaatagcaagagttagtacagataacgaatcaagtttcagctccccatcttgcccttttagtgttttatgcatcctatagaattaaaaggacacaaatagccgatgatacagacatcaggggatttatacatgcttgaatctggaatggagttatatggcaataggggaagataaaagaggttatcactgcaggggttggaacaaggaactgcataaacatgctgcagcagtggcaggagaggtttcctgcagatgcacgaattcaagtgatttcaggctactcttgtgtttaagactcgatgccatcctttctgactcacaaactggttggtacgttatccaaatctctaggttaacgtggaagtcagctctttccacgcatgccagccagctgcatgctaaataacttgagggtggacatttgtattttctgaatggccacagaccatctggttggtgcccatgattaagcgccagatgctgtattcgttaaaaatcatcacccttaaagattcactcatcaccacttaacctgaatgctctcctgaagatggctatttcaaaggcattgtgtctgctgaatcacatggaattcggcacctatatactagacaacataaatctggctacctctggaaatttcttcaccagtaagctgaccaatggagtaaccttatgtcagttcatactgaaatttgcccctgctaccataaggaacggacaaaatcttacaactcctctccaaatctctgtccgttggtaacaaggctaggctgaggcatacactcgaagtctgattaagatgcaaaataggtttctggaacacaaattaacacatgatgccagaagaagatgggtttgatgggtgacagaaagctttggggcatggacagcagtgagccaatgatagcttcagggtgccaatgccaacggtagttgagggagggtggtagccaggcaccagtgcaccacgaccgtggctggacagtggctacaggcatacagtaaaatcaagtacactgttggcatatctgacaagataaaagaagagtagatcaaatgaaggtgatggtagctggagaattgatgttgctggcaagagggtgatcactctggttgcattgggtgggaaagatagctggaagaacaatagtgagagggaacgaccaagcccccagaggatggattgctgccatgtcacattcatgatttaatagctcaataattcccattttttagtttttttatacacacagatgaagcatccgtgactgtcagtttcacatggaaataataatggccaggccagaggcaaagtgggatgccattagactcaataaaatagctcggaactcaaatcaacaacaatggtatatgcactcaattgaaatataacatacagtgaaatttacacaaaactacaagatcaagaaaatggcatgttatgcattgatgaaaaccaacaaaggtgtatctgcatgtttggacaataaatgtgatatcattcacatgaagaacaacgattacctgacagtgctttgttcaataatgaacctctgactaggagtgtgcctggcatttgttcaaacacctatatggaaaaaatacaatgattttttttttgaaatatacacagaaacaactgacaagttcataggaaaaaaacataactaggtaactgatgaacataatatacttcaatttatcctaagcataccgaaatacggaaggatgttccagtaacaccactatgaagctttgtagagttgccttctacagaaccagattcatcgtgcaacattgcagcctgagcctgctcatctgataaggtaacctgaaagaagagtatttcatacaattcttggagatcgatacactatagaatttgtacaacaacaaaaaggtctgtgtactggtgtaatttgacagaaggaatatgcggcagattaataaggaatcttacatcaatagaaaataatgaagaatcagttttacacgatagattagaagcatggaaaaagctctcagctgacttcagcacttgaaatgcaccatattcacgtcgaaggccctgaaagccattatgtaaatgagatattgaagcgaagaagcttgagaaggtgcaatagtagtggaaactcagtatcaataactcacagataaatataagttggctgattagctctttattaataagaggaaagggcgcaggtattgtccaagaacatacaaacataatggtagataagattcgagttggatttctttttcttttggttgctaaagaaaaatagctgtgcaatttatggaggtaaatgataatatgaatcaaagggacaaaaggtgacgtgatactaacttgaagcataaaagaatagttggcttttccaggtgtactggatctaatgaccattttccttggagcaatgaatgaccatgcaaggccccatctagctgtttgaccttgcacgaattcagtagttttcacaactgacaccccagcttcacgaacttttgaaaccaatatttttagatttgcttttctgccaaccatcgaagtaaaccacctaaaacaataaaaggaacaatgagcccagagacaattaaaaggctattatcatgttaggttagtatttgaatcacctgaaagagttcttaagggaaacactgtcttcaattatacgagttataaatgcctgttcaccaccaggacaaaccatctcttcagcagttccaccgcatgaagtttttggattaagaccagcttcctctatactttcaaagaaaggaggattgcacatacagaagtcaaagctctcactatccttcacaacgccaagaaggatagatggtttcgacctcagtacaccatccactggcttcgaagtgttctccctggctgcttcaccatcaactgcttcagattcagaagaacaggacattttgtttgcatttctaatctcaaccagagctgctagctgtggattgctctccacattctttttagcccattcaagggcaacatcagtgacatctacaaacacaggggtaatccgattaaaagagaaatgcaaataaaagttcaactaacataagaaactctaattgatgctttgcaaaacttatattgtacatgatctaaagcataccagatccaacaaagctccagcctagtaaagaagccccaagcagagggtagatgcaattggcacctgtgcctatgtcaaagccccttacagtcttgtttgaactggatattggtggtatgaggtctgatgagagaagatcctcaatccagtggatgtaattggatctgtttggcacagtagggcacagctgtccatccggaatccacctgacggtagttagcgacaaatgtcatgttcatatattagattaaataagatattgatcacaaaccatatgcatgacacttagccaataacatattgagcactagtaaatattttgcatgacaaacgaacatcacgattctctctcttcaaataaacatggcagctaaaacttcttcagagaggccatttgaattttgaactgttagtgcaacaatagtaccatttctgatatagtagcatcatcagaaaaactactgaagttacttagaacaatcaaattccctcaagctcactcctgatagtagcaactagcatcaacagttcatagaatgacaaatgagacgcaacagcttgagctcgatgctgcggatggctgaattgagtggtaccctagtgattcttcagcagagcaataccgggatgcactagaagcacagacggattagggttcagggaagtgagcccagagagtgtaattagtaccaaccagttgacgccgtggtcgtggaggaggaggacgcgcgtgagctcgcgggtggcggcgaagtcggtgaagtcgatggaggcgcggcctccccgggagacggagacgaagggggcgaaggacgggtagagcgacgccagcgacgcgaagtccggcgccgcggcggcgtagcggttgcgcgggtggatcgccggcgcctccgagccgtcccgccgccgccgcttcctcccaccccccatgacgtggatggaccaacggcggcagagctcgagcagagatcgccggagccccgaagcgccgcgggggaagcgacggcgagcggcgcggcggcgcaggtcgggtagaaaagctcggggttttctccggcccaatccttcgtttagatctttacatgggcctcgagtccctatcacggcccatccacaattcatctttgtcaaatgcagacatatgtttggcagggcttcagttccagcttcatctatctcgaaactgaagttcaaccaaatggtttggagtagattaagtggtatgaaaaactatactaagaaggtgaagcggtgttcagctccacaactccgctttaaactcaactccaggagttggaagtcctgctaaatagaccatagcatagtgtttttgaaattcactgagaaaacaagagtatgaagacatggtttgtgttttcatcctacaatgtgatacaggtaaaaatgaaaaagatgtcagtgtcatttatcattaagcaaaatttataaaccaccaagtttagggtatctgtcatgcaaaccacaaatattgtggttttctttaagaaaccttagattttgagtaaaaccacttagggtgtgtttgaggagaaggggattgaggagattgggaagatacgcaaaacgaggtgagctattagctcatgattaattgagtattaactattttaaatttcaaaaatagattaatatgatttttttaaagcaactttcctatagaatttttttgcaaaaaacgcaccgtttaatagtttgggaaacgtgcgcgcggaaaacgaaataaacaaactcactctctctcaccctctcgaatgctgcctaaggaaatgtttggttgatgcctaaccttgccataactaagtttaggctagttgtggcatggtggcataaatgtggcttagaaatagttggccacaagtgtgtcatgcttagctctaaatttgagagcatgacatgtgggtcccaaagttaagaaagtgtggtataacacaattgcggcagcgaaccaaacacatgcctaaaaaactgtggcatggctaaagtgtggcgtggcaaagtgtgacaaccaaccaaacagccctaaatgtttcgtgaaactttgtgtaggcttacattgttcatttaaccaaatttatgaacagcaattgtgttaaaaaaaaggtagtatgagatattttttttaggtacatatacacttcaaccatattttcaatcaacatcgagtattatcaacagtatggaggtacgtgtgtatatgtaatcgactgttttatatcttttttaagtggaagcggcaagagtattgccgaatatattagaaagatagtgtgtgaccctgtttataaggaaaaccgggccaaataacatacaactgcgcgttttgctaaagtgaaaccggcaaaaattttacacagaagacacaaaagcctaaggcaaacacaactacaaaccgcataaggccgtgggaagagtaagatcctaaggcgaagccggagatgaacaacgacataagccgctgtcgacgcccgacctaaacagttggactgttttatatcattattagcgggggattgtattaagtttttcaataatccagcgcaaggataagatagaatataagatgacaaggttgtatttgaactttgtattggaatatgtttattaaaacattttgcccaaaatataatacggatgtcttaataaaaccggttttgggaaatttaatatttatcatgttgagcaattggagggtttcaagatcattttttgcaatggtgagatttccttcaccaactattttttgttattaaaagggaaatgaagtcatcttgtatttatgtaacacaacaaactctccacatcttcttataattttctcctctgtgtttagatcctgaaatgaattggagatcaggttttaggcgccacagccaggtgcatggagattggagacaagacgaaacggcacttgcctgcaaaaagtagtggatactgtctttctacttctccgttcttccaatgatgaattggtgattggccttttcaaggtagttgcagcaagtatctatctatatatcctgaagatgacaattggaatcgatgttcagtgcgtcgtcaccaccacttgtcatgctttcagaacgtcaacgacacacaacctctcgttttttcctttttgtgaagtaattttggcgaatacgagcaccatgagaacagaatttcgcacaacttggaaagctgttcttcaatttttgcgattcctaacgcaaccgcgtgtggaaagagagaaggaaactaaagtgagatcgatcgaatcaagcatctcctgcgtacagtagctgccagccatgatcacttgtggcagccatacttgaggcatctcgatcgttttcaggacgtctctggcttgacagctgagttgagattattcaggttgatctttttgcttggttcagatttcagatccgtcagacttttcaattctgttttcctactcgttttacaggttctgaaattgccaaatgccgaccaaacgaactcaacacaagacgtgattctgttggtattgggaggagataggaaggaaaaacctgtcctgcaaatgcaaaaatgcaatatgccatattgccttccaatgagagtatgtcagcattcaagcaaacagccaaacacagattatagttcgtcccatagaggctggatgtggaacgttagccaaaaactggatttgtaatcctaattttaattcattttaggcgttccttttcaaattttttaaggctgtgtttagttccttctaaaattagaagtttgggttgaaattggtacgatgtaactgaaaatttgcgtgtgtatgtcaggttgatgtgatggaaaaagttggaagtttggatctaaacacagcctaagtttcggctttttaaccaaatatcaatatactaaacgcctaccgtaaaactactttttcgtaacatcgtttttattctatggcttataactcgaagcctatcaatgtgactagtactattttattacttaatgaaacgtctatacattatatatatcaaaatgttataaaaccgtaaaaaagccatgatatcaaactgacaaaataatactctatccatcctaaaatataaggaattttatgtggatgtgacgtatcttatactttgggtgagaggaagaggtactaataccactattatattgtactccctccatactcgtaaaagaaatcgtttaggacagcgacacggtttccaaaacacaactttgacttcttatttctataaaagtatttattgaaaagtgatatatgtatacttttataaaattatttttcaagacaaatctatatatataatttttatattttcaaactcaacaacttaaaagttatttatgatttatattcctaagatttgatttaagcattgtcctaaactactttctttataagtatggagtaatatgtattggtaacagtacagtatatacagcagtagtagtagaatatactgtactgtagggggaggtttgggccggcagaggaatgggccagtcgcacatgccgtctgcgtgcgcttcccgcgacctagaatatcgcccactcgctcaaccgcatatcccttcctaataacctctccgatccgtaaacctcgcccatgcgccacgtcccccctagtgtcctacctcccggaccacccggtcttggtagaccacgtccacctccccaactaaaatatcctccctaacccaaccaccccacggtaacccacgtacttaacgcgagttaccccccgcaaagatccaaccgcctctcgcaccgcccgcctgtccacccacgcctactgacgaacccggcccacctctccgggccccaccatgtcgtcaccacgcaggccaaaatcggggagagcgtgtcgtggtcccacctgtcattggcttcgtgggtgggagcgggtcacgtgcatctcgacatgactcgaggaggtaaccatggttatggtaaccccaccgccttgacacccgtggttaggggtgggggcgcgcgatgccgccacgtgtgacgatcggacggctgcggagggcatcggggttgggcgacccgcctatttaaccgcgggggcctcgtcttcctcaggccacgcagcgatctgaagtgaaacagcaaaaaaaatcaaacaaaaagaaaaaatattccccatctgtgaaattcgcaaaaccctagcgcggcggcgatgtcgaacacgagggtgttcttcgacatgaccgtcggcggagctccggcggggcggatcgtgatggagctgtacgcgaaggacgtgccgcggacggcggagaacttccgcgcgctctgcaccggcgagaagggcgtgggcaagagcggcaagccgctgcactacaaggggagcaccttccaccgcgtgatcccggagttcatgtgccagggcggcgacttcacccgcggcaacggcacgggaggggagtcgatctacggcgagaagttcgccgacgaggtgttcaagttcaagcacgacagccccggcatcctgtccatggcgaacgccgggcccaacactaacgggtcccagttcttcatctgcaccgtgccctgcagctggctggacgggaagcacgtcgtgttcggccgcgtcgtcgagggcatggacgtcgtcaaggccatcgagaaggtgggatcccgcggcgggagcaccgccaagccggtcgtcatcgccgactgcggccagctctcctagatctgtgctgttccccttcgcctttcgccagtatcagtcgtcttgagtcgtcgagtccctaaataaggaggaggtggtggtggtgttagtctttttatgagttcgtgtcgtgttggtgagatgagatcgcccatggtttggttggattaggcggagttcttggatcgattcggtggagttggatctgcgatccttcttggggttggttttaaatcttaattcgtgtcgctgcttctatgatatcgctatcaatcaatgagaacatttgggatccgtggattttctgtgatcttacacctgtgtggttgtttgttcttgcgacagtactaacgttcttgcgattaaagtagattaaactatcttcgtgagatgagcggtttgtcgccgcgtgatgcctgactttgatgtgatttgtgggacttcgtcttatccatttggttattattatttttttattttgcaccgaggctctctctctgatgtgatccactgtttctgatctctgatgttaccaccaccagagggtaatttgatcgcttaccagatctctgaaattatgcttaccggttagaggggtaaatgatcttacaagttgtttacaggttcaagaggtgaacataattgcgtttcaccagaggatactagaaccttttttgtgttgaaaaatctattattaagggcagcagtactaaactgaattattatgtcttgaaaattctattattaagggcaggagtactaaactgaaggtcgccgttattttagtgaaaagacaaaagttgcaacacctgtagtaggagtagtactccactttgaagaatgaccattctgaaatttgctaggtacgctgtcactgccatcatcttgctgccttgcctcccacaaggccacaacccagcgtacaattgtacaatcaattctctctgttttttttaaatcacaactttcattagccatactaataactccctccgtaaaaaaaaaagacaaaccctgatttccgtgcccaacgtttgaccgtccgtcttatctgaaaaaattatgaaaaaaattaaaaagacaagtcacgcataaaatattaatcatgttttatcatctaataacaatgaaaatataaattataaaaaaatttcatataagacggacagttaaagttggacacggaaactcagggtttgcctttttttttacggagtagtacttagtactatagtatttttttaccgcgagcacacaatatatttgg

SEQ ID NO: 69638 - DNA, 11642 bp, Oryza sativa
tcctgcagcccagcagtgagacttactccctccgtcccaaaaaaaagacaaaccctagttttcgtgtccaacgtttaaccgttcgtcttatttgaaaaagttatgaaaaaattaaaaagataagtcacgcataaagtattaatcatattttatcatctaacaacaatgaaaatactaattataaaaaaattcatataagacggatagtcaaacgttggcacaggaacccacgttttgactttttttttttataagatggagggagtatccttgacatcaatcacgaaatttccctcatcccgagcggtacgaatcgcatctcgtggtagcaccaccagtcaggtctagcggaacaaaaacggagctagtcagatttggaatctgtttatacaattccatctccatttgatcgcagcatattcctttcctgttgcaattaacgctagcgtcatcatcacaaagtgcaactcataatctcatacgcagattgatttgattctccgtgtaaggtgagtttagttccaaacttttttttcaaactttcaactttttcatcacatcaaaatttttttacatacaaactttaaacttttttgtcacatcgttccaattttaattaaattttcaattttggtctaaactaaacacaccctaggtaaaaataccgacaaattaccatcatcttccgaaaacgtgcaagcaaaaaatggcaaaggattgtcatgaaagtttacacgctcggtcgatttttttctccctgtgtgtgtgagccaggtgacggtggggcccacatgggtagagagaatacagggaaaagaggcttgggtcccacgagacagcggctggtggcggtgaaaaggaggacggcgcgcgagattcgaggcagcagaggagggttttgtttggcgtttggctcatgaatgaatggatggatgagggtggggcccacgtacgtgtgcgtgcaggtccaggtcgcgttggtgctacgcagtgtttgacccggggtgggtggttgggtcgggttgggcgggtcggggtcgccgcgcgcgtcggggatcgcgtcgcattggtttggcccaccactactattgctttccctgcccagcccaaatgcaaaatgatgattggcctggccctcgtcgcgtctcgcctgtcagccgcgaaaatattggctcactccgtcccaaaataaatcacagataacatattattatattttattattatataataaaataaatattaagcataaatattattggatgttcaaacgttggacatataaaccacaactacacaacatagtactatttttaggtccccatcgtttcgcttttttttctggcttattaggaaataaaaataaatttgtaggtaaaatttttatatatgtgttcttgatgacttaaaagccaatgctgaaaaagaaagtacgttgaaaatatctcaaaatcaatctcaaaattaagtttgaatatttaaaatttggctttttctttggcttattaggccatccgatgggagccttagtgtatttttttcacgttttaaattgatcttgctgtcaattttactatgcataaaggttgacatatattcctagatataggtacaaatattaggattcaaaatttgtatacaatttaaatgtaaatatacttatagttattatttgagaacacgttgcataaaaaaaagtatagtacgatactcactccttcgaaaaaatctaagacctattttatttttggtttctgtaaaaatctgagtcatatttgtagtcaacatgtgctaaattaaattgttgatcggaaaccaagaaacaattctagtacttattgattgcatgttcattggttttgccatatagtgagtgagttaattgcttcttggttttaatgaaaaagaaatagatctcatatttttggaaggatccatctacttttgatagtcatatttccaaatctgaaaattttatttttgataggcatattttaattcaacaacctatcctcttaatgaatttctcggatttaatgcatgactctccattcttctacacaaaattggctatatgggcatcgagaaatgtaaatattaatgaatcgcttgtttacgagaaatgactattagcatgtttaaatggatgataaatagaataacttattcttaatctatatgccaagatgaaatattactatcaaaagtagatagaaggagtactacgttctagcgctacgagtttgttttttttttatcatacgagttgtacttttatacccaaaaaagtcactctgtcctgtcctgttgaagattacagtactggtgggttgatcttctagaaacagaaaatatactttacaatggattagtagtatggtttggaaattatggagtggtgacgagtagtctgttgaagcagaaatcgctggcaatcaaaagtagattagaaacagtggatttggggcgtgatggcggtgaggttgcaaccgcgcaagcaacggcgtcaatgcctccgccggtctgccgtgattacttcacctgcgaccactcgtctgctctgcgtcattctgcctgacatcctcctccgttcttgtcgctttcacaacgtggaaaatgagggctccattattttgtacgattttcgtaacgtatgaataagaataaaaaaaatataggaacaatatgaaaatatatgtgtaaacttaagaattgaaaaacatcgaaaactttaccatgtatgttcagtaaacaatccaaaaaatttaaaacattgggttggagtggattgttttttccccctataaaagtagagtgataataaattcctttttgctggatccctttaaaacagatggcagtttagtgtcactccaaaggatcccatatttctctatttttcctttaaaatttctttgaaacgaatgagcccggaatggctcatcatcttccattcctcctctcagttccatccaactcacacatggatagagtggagatgcatcactgaacacaagctagtttcagaaacatcactgaaacagccaagcatgctggtggtagtatctatcacaggatttaggagcagctgcaggaagaagagaattcggtttcggtgctacctttcatcctctgatctcagctgtgttcagttcagctcttggcattgctaaaaggaattgttagttctatctagttcagttcagctctgaatatgctggttttacgtttgttgcagatggtgtctgtcactgaagactgaaactacatttaaactgtatatgtatcatgcacgattagatccagatgggctccttttctggcagaaaaccatatacatcaatacatgctggttgctggatcttcatgtctattctttcctgctggatctactatagcttattactagtagatttcccagataatattacctcgatttttcagatagacaaattctgtctttgcacagaaccacacagaagacgacttactttcttcaccctgcatgctggatatatagcccttcaacctataaaatcgatggagatatcatcatcaacagggaactatcatctcatataagttaaaatttgaccttatctgatctgccataaactgaactttggttctacttagtgattatctgggaaaaaaattgttttttatccatcccacacatacctatacaaaatttatcaaatcccaatgcaatgtatttatcctctacttttacaaacttcagtagaataattattttaaaataaatttattttgagattcaaaataaatgggagggatggaaaatgatcatattctgaaacggagggactgagggagtattcgttatactactgctgcttatcttctcttctgggatagggtggcactgtggcagagcatattgaacgttctttggggagagagcccagtttgacaaatagcccaaattggcctactagtcactgggcttaaagctctgagcattttttattgggctcagttcagaattatcgggttttatccctcaattcttcagcttttgatcacaaaggaataagtctattttgccttcctcatctcttgcctttgattgaatcatatctctcaaccataaaactataggtataatgtctcttccaacttcagaaactggtgcaaaatgactccttgaatggtttaggaagctgtttttgttgtcgtgataggtgagacccacatgtcagcgactttcgcctatctcatcctcttacttacctctctcctctcttcaatcttccctcctcctctctcaccttctagtcgctcacctgttgttttgatgccccaacctcctctccctcgctgctgcagccactgcctattgctgcttttgcttcaacaccaccatcgcaacctcctctctccctcatcgtcacagttgtcgtatgttgctgctgctgcttcggggaagtcgagggaaatggaggaggcgctcgcggccacaggaggaccgggtctaacaggcgaccttgggagggtaggatccagctatagggcgatgtccggtggaagagccaaggtgtcggtgaccttatctccttccgagtagcggtggcgccgacatcgagcttgagtggccacattgtctcctctccatcctctcccgatcatcgcggatgacggctttgccatcgttgggcttgagctcttctttatcctccactaccacgccatttgcgtatcttgcccagaccgtctgagcccaaggagagatcttattttgcgcccccggttgcactggatttgattttaaaatcaccatccgcgtacccgacctgattttgcggttaagagatctgattcaaccgagggcaagagacgagggaagcaaatagatttatcccttcacagaaacatgactactgactagtgtcttatttgggtgggcttcaatcctggcccatccacatgtatgggacaaggcctaactagcacatttataattgtcttgtttttcatatatccagatatctatttagccataagtatggcttctttgtgagagatttaccgataaagatctgattattcctaaacggcaaaataggcaggcccccagcggaggactcatcaagggctaaaatcacgcgatgaacaatatcatgggccttaactagcccttgtcccctttctcatgctgaatcaaacattcaaatcagattcgatttaaatagtttcaaacctttcaggacatcctttcattgttctccactgtactggtaagagtaaaacaactgtactggtaagagaaaaacaatacattgagaaaactaggatattgggatattgtggtattgtcttgctcacaaaaagaataatatatgtattttatttccctaaagaatgatgaatatatatgattagcagttgctatcaatcttggctgcatggccaaaatacaatactctcctatggtaagctagctagaactgctaaccagtctcactcacacactattgcaaaacaagatgaacactcgctcaactgtttgatgatgaatatagaagctaacaaaatttgtaattactaataattaaacctttaatcactagctactttgctagtagtaatccgatcgaattcttcttcctcctcctcttcttcttctctcgttgcactgatccaaaaaagttggatttctggcaatggccaatcaggatttcattctacccgcctcatcctgctcgccgcgctgccgccttgtcacgccggatctgttgccgccggagccgcgcctccgcggtcatcgccgccttgcacgccatcgccgcccgcttctgtcccaggtggtaccactccgccgccgccgccgccgccgcggccttggcggcggcgacggcgacggcatcgtcgtcgtcctcctccggcgcccgcgccggctcgttcaggtccagcaccggcgccggccggacaatgtcggctgccgccgccgccgcctccacccgccgcttccgattcacctcctcttcctcctcatgctcccgctgccgcttcagctgcaaatagtaaaaatgaaaaaaaacgtaaaaaaagagaaaatgaaaaaaaagtaagatgaggttgactccgactcaattggggattattcggaaaggtcgcatctttctttccatttggactggttgccaaccatgccggggtgtcaggtgtgtgtccacgcaaacacctcgaccaaagaattgaattgaagcgcaagaaaagagtagcactagtgaagcattgaccttatcatctatctacaacaacgatgaatcgatcgaacataatttgtttttacgattttagaggatgcaaaaattggagatgaatcgatcgaacataatttgtttttacgattttagaggatgcaaaaattggaatatatgtagctgtaaatttttttaccttgcgctgcatctgcttcaatccgtcattggtgctcctcgagctctgcagccggactctgtactcctcgatttgctgtttttttattcaccacaaagatgaacaagtgtgtcaaaatcccaacgatttttgcgatcgggatagttgaactcgagagcgaattcttcatccatccattcagttggagagagagataaagacttggatagatagagagagagagagggtttgataaatctcaccttggatagatgcgagttttcctgcgacaagctcgcgacgacggcgcgctgctcctcaacccactgatgagcaaagcagggaagcaaaaaagaacagatcaatactgcttacaagctaaaatcaaatcgaatccgatcgaattgggaggagaagagagagcgagcgaatcagatctcacctccgcgtgcgacgccggcgccttcctgggcggcgccgccctcgccgccacgtcgtcgccgctgctctcgtcggggacgaggaacgcgagcggcgtgtcggggctggcggcggcctcgtgtcgccgccccacgtccgcgggcggcgccggcttcttctccccaggcgtcgtcctcggccggcgacatccccacgaggggatctcctcgcgctggacgcggcgtctgcggcggcggcgatggcgcgcgcgcacgaggtcggccaggtcgcggaggatggcggccacctcgtgctcctcctcggtgaacgcctcgacgacgacgccaccgctgctcgccatggcggcggcggaatcggcagcgagagcggaggagagatttcttcgtgagcgaggcgagagagagagagagagggagagagagctgagctgcggattggtttggtttatagcgagagcgccacgtggcagcggggagggcgtggggattaggtgaccgcacggtggactccacgggtgactgactggtgggtccctggttttagcgactccgttatggttttgcgtgcggagggagtctggttttaaaggcttcacaataccgccccctgtttcaggtttttttttttcctccgtgtaaacagggaaatctcctattgagtttacatgtcatgaatctaagcaaaaggcttaatttcaaaatgaggggaaatctagtgagttactacaagggaactgtactaatttctaggaaaatttaactaaattttccttaaactagcgagttcgacacggacgagcgatcaaataagatcgagtttttgttgagagcagggatttaataataattttgtaaacaatatccatatgtttcaaaggagggctgaataatttagcactcgcattttcattaattacgcccccatcatttttagattatttgcttcacgctttttaaaatgttttcttaaagaaaattttccctactacatttgctaaaaccatatttgttctaaactattatttgtttttttattttttttcaatgcatctaatttcttcatataaaaaaagtacttcactacactcgagtacctttcgatcgagcaacataaaacatctcaaattaattacagctttttgccacccattggcatctgtgactgtcaaatgtcatgtcaacttgtctgaaaattcctttttgtcagatgaacacacagaaacagcagcagtgacagttttgctatgctaataagctagatcaacctcagctgcggcggctgtctgctgccgccatggtacggcgagcagaagagctccatctgcggcggcggtggcggcggcggcgcaggcagcacggccaccggacgcagggaagagacgtcgtggagccggctgctgtgctgccacgccgccgacacggcggcggcggcggcgtctggccttggatgatggtattgagggaattgaaactgccacatctgctgctgctgctgatgctgatgctgattgggcatgagctgctgctgaatcttcataatggctgggtttggattgcacatgtactgtggcatctgctactcgatggccaagaaacaaactgtgatgagaaattgagaatacaattgaatttgtatagcaaaaaagaaaacaatcatgttgtttgcagtctctcttttatccacatttcgttttgtcggaaaaggaacaggctatgatcaataacgatagaagtggttttttttttctgtattgtaagttgtcacaagaaaaggagtttgtactagtaactgttatgagatgcctataaaaaagttagtggttgtctataaggcattgacagaaaaacgcctcacaaatcttgcaaattctaatagtactattaatgatgtaaatctttcttttgtttcagaagcaatgtgcaaggacaaacctgttgaagtagtagtgcagtgtgcgtcaaattccccctggtgtaagggagatgctgaattggatatggcattgcaccgcggggagcgatcgggggatgtaaatactgaacatgctgcacccctgataacgccgcagaagtgggcaagttcagaaaattaccactgacctgaaagaagcaacacaacatctttcatatagaaacagagatagaaggaaaactgaagtagctgagatggttgaaaaggcggtcactgctcaccatcttttgtcgggcaatggtcgtgtcgcaaacactgcaagatggctgaacaggtagccttacatcgaaatgcaaggcgtagaacttctcgtcttgtgcaccattcttacttatggtagaaccgtctggagaccttgaaatgtgactgtgacaaacttcctcaggttttacccggttttgtgatgccttctctttgtccaaatgcatttggatgagatgacacatgtagacatgggtaatgcttctcttccatgtcttcgagggggtaccatttttattaacgagggaaagctgcagatataaaatttgtcagctcagtagtcaaagaatacaatcatagcagttaacatataaatatcccttcatgatatcagccttaatagaacatagcattcaacttaggagagagagtttccttatccatttattctggaagaaaagaaggcatagaaaaatggatatgttaacaatacttacattctcatgttctccagttcctttcacagtttctgcggcagtattattacacgacgccagtgtgtttgaagatggcctggaaaagggacatatttagagatcgatgatgaaaacaacactgaaggtttaatcgaaagttacttgatcaaatacctatgcgaggcacaaggttttgaagtctggaccggtggcacaatttctgacaatagtgaccatgtattagccaagaaatagtagaagcatcgtgactagttggacaaaacggtatgaactattcaacctataaattgttatgacactataaagctctatgagtaccttgggcagtgttattcttgacatttttcctgtcatgttccagaatatcaggcttcttagaattttcctgcagaaaattcatattggggagaaagcatgaatcgtaaggacagactgaaaagtgaaaaaatgacaccgaggggcacaaagcagtaccaggcaccgaggggcttctatctttgtgggatgaattgtactattatcaaactgcactttcagttgcttccgactgcaaacagaaataatcaaataaacatggagagaccatttaccaaaatacaatacgagatacgacagccatgagcaatttccaacctgttattgtagtctttagatgggctcggtaaattcgttacaattcccaaagaaatatcatgtatttgcccatcatttgacaaagttggatttgtgttgttgcaggtaccaccacaaggcacatgatttatttgtgaaacattgccagttcgttccactggttcatcaagggcaggttggttagctacttccgtaccggcagttggcaatgccgatattttctcatccacctttgttgctcctgtagaagtaaccagtcaattatatatgcaacacattgtcaaaaagatgctgaatatagtgattaatacgataatagcaagtcaaacactcaaactgcaaacatacctgctgaataagacactgaagtaacatttaaatctaagttatcttctgccattcctctgtcggacgacagttcacaaagatggggtatttgagataaagatagcaaagcatccacaactacctcctcctccttcgaaaaatgattcgccaactgctaagcaagaatgaagaaaaaatgattcattttcaatatttggtcctgcctcttgacaaaatgaagagatatttatgagcacaaaaacttaccggaattgcattacatcttgtttctcgatccataaggaaagtctgagagctgatagctgaaagatggcgcctcttcttgacatgccgcggtgatgtagaaacagtttgactggcacgtttatttatggctgaaagtagggggaaaacagaatttaaatattaactcagaaatgtaaatctttaatctataatttgaactgttattttcagtactcaaaacactttagttaataaaacatctaatatgtgtatgcaccagagctcacggaattaaaatgaaaatggtatgttcaaatatcatagcgaaccatcagtttgggttttgtgttctcacaggtgaatagtacccaccttaattaaaaaaatgcactctatattttctatcccgctgtaaaatcttacagtattatatgctaaaagtcttgcgagaaaaaatagcacagcatattcacttagccccaccatagatgtaaactaaaaggaaaaggcatgataaaagcacacgaaataagttgtccctttctatagctctgagagagaggatatacagtgattagtactcctacctgatcttaattttctaggaaccggtggatcaatagcatcacaatcctcagccacctttgaaacagaaaaatgaacaaaaaagatgtacataaagaacaggaagcaaatgattgaacagcagagaaggctaataaacgggacacaaaccttcccaaggctcttcactctcttcctactaatcagactgctgaagctagctgtggtcagtgaggagagcactgtatcatcgtagtctccatcagaacctccttcctcccctttcatgtccatgtcagtgttgcttaatctccacttcaaaacctttgcctttcctttcttctgcctagatatcaggtt

SEQ ID NO: 69639 - DNA, 33397 bp, Oryza sativa
  unsure (1)..(33397): unsure at all n locations
agaggcgactggcattagatatcgtgtgtaactttgtactccggtaactaaagaattttatcttttgaaaggttgtggtacagtttttagtttcaccgtactccagtttagataaactaatcgtttagaaccaataagcacttcatccaagtgtttagttcagagtctttttaaatagtttttgttgacaaaatatttttaaatagttaagaatcagatgacactcttggaaataatgcactattcatctgatgaaaaggtgtacagctacagaacctgtatattaaaaaaaaagaaaataaaagcaatatatagaatcatttaaaaaggaaaagcaggaggaaaaataagctcattggtgaatgtcatatcatgctgcgaggagaactttgtgttgtgaaaaggatagtaatcacaaggtatggcttggggtgcatatctacacgtaagcagtaggtgacaatcgttaagacccaagacaacatcataatattttggagatttcttcacgaaagtttaacctcatcgaaccatccaaaaccagaaaggtctaaacaataaaactttccccgaaaaaaaggtactaccaaaaaaaaagaggtttcttgtggtgtgtgatcgatggtgaggaaagttggcatattttgtatgagctcatccatccaaagttccaaaccaaaaggccaaaccttatattgactgtttaaacataaattcatgacaaacctagattcactgtctgaacataaactcatgacaaacttaatttgaccttatattgactaatacaaattcatgacaagcttgtacaactactgcttagtgcttactctactcatatatgatgtaatcatttactctagctactatgcagtagtggtggtctctagccaaccccctagcagtagtacactagatggtgtgatcctgcccaaagcaatactacaagggtgctaattttccaagaaaataaccttaaaatggggtttcaaaaagaaaataaccttaaaaccaatcacagcgccatactaggaccctatatcaaggtgatcagtggggcccaccagagtggaacaaaagaacaaaaaagagcaccagaaaagattatttttttatttgtaaggatgcattaggaaaggcaaaggagagataattaagataaggggcattttggggaaagatatatgcatgagtgagaaaggaaagctgctgggttagttcactgtaaccatctggactggacacatgagagagaagagagaagagagagagaccactggggcagaagagaacagaacattacataccagcagcagcagcagcagcagtaggagaggaggaagaggaggagccactccttatcatgtgtcttcttgtgagcccagccaccagcttctccctcttcttctccatatccaccatccaaaaggttatatgcccaaaagatctcagaaaatctccatctccctttctctcctctcctccacacttaccataggcctacactacacacaacaaatgcagcagtaatcagtatgaatgaatacaagaagatatacacacacagagagactcaacaacaaagtgaactccagctttatggaagaggagtaatgctagtattgagacaaggagacagcatccagagggtcagcagtacaatggaagcaaaggcaataccaaaaggttaggataaaaaaagggggagttatgcagcttggtcctgtgtgatgaaatgcagaagaattagatgctagcaaagctgatgagggaaggggggaaaggtgatagaaaaagaagaattttttttctctggtggtgtttcttgactggaaaagattcatggatctttagccccccaagaatctcaaaaagaaaaaaaaagactgcatagagttgcaaatcattatccagatccaaccaaagacaccatctttctgaattcttcagggtaaaaatgaaataagattttggctcccattcgctgcagggaaaagatagagataagatcactctgcgcacatggtcgcatcgcaccttggaaaatgaattcagggtattctcccccacacaaaaggcttgtgaattttaacgtcaaatgctctgtccgtttcaagaaaaggaagtagtaataaactatttaattcatgctactaaactagtcatatgatttgatttgcagtgaactccacatttcatacccttttgtctcgaaatcgaaattatgccaagaagttaatcaaacaaacgatggagacgaagcatgtagcaaaaacataaaccaaaccgcgaaatcaaagccaaccgaaataagatagacagacagaacagcggtcaagcccatcctgaaatcgagacgcaaccacgacatcaaagaaaccgcaagaaacagggcagaattgcagggcagttgatgaagaagaagaagaagaagaagaagaagaagaagaagaagaacacaatccacaaccaaaaccagcagatgaatcccccttcccttcctccaatccatccatccatccatacaaacagaccactccgaagcactaacctccagtcatatgcctatgcaccgatccatctctccctccctctctccaagcttcttgatcagcagcaacagagagagataaagagaaagagaaagagaaagagaagatgcgagatggagatggagaaaaaggcgaggaggcgagcgagcgagggagagaagggatgagtaaatgcgaggtggaatggaagagcagcaactgcaggagacgtcgcgctttttgttggccgctttggcgtgggcagaaacggaaaccttgcatctgcatgcgctgcgctgcggctgccactgcacttgcatctgcggctcactgccccacatgtactaccacttcctgtatagaccaaccaaacaccaatacagcaaaggtgaaaccaaggtggatggtggtggtgattggtgcagggtgatctgctcctgcttctatggcaatccctatctcccacttaaaaaatatccccaatctctctttctaactgggtatttagagcaaaatattgttattgtgggttatctattattctagttcttattgttgcctgactattagctctctttgagaggtttttttaataagtagctatagcttcttttaagtaaaggctggaatttatattccattattaaacaagctaaataatttttagaaaaaaccttaataaataattaaaaataaatggtctaatcagtaatgcaatagaacaaagttttagcttttattgcagtcaaggcctaattatctattatataaaaaaatactgaaattttggtatggttggttgcttgattttatctctgctgcatccacagttttaattaatctaaccttattttttaaaaaaaacttaatagatttattagtttattaaaacgagtggtctaagtaatacaatagaatacaattttatgataaaacacatattcttttaggaggtagagcattatagttcatttcggtcatctggtaaacaatatgaaaaggaaaacatggtaacatgtgtgtgattagctagctgtaattaaaagtgcaatcaaggcaaagttatggatgaatctaccacgtgtaaatatggagtcctctctgttggcatgtgattaattgtaccactctttgtacaatctgctctggtccatttacaatatcacatctgaacgtactgattccaattatacaccgcgatatactatatcttttgatttaatggaggagaacatgcaaatatgcaattcaaatggctcaagatgattttcttggaagagagtagaaatgagatcatgcatacacatgagttaggaactcatcccgcgcatacgcaaaacggacaactcattagtacatgattaattatgtattacaaaacagagtagttattttttttagaatagtactaatatgatttttaaaaataacttttctatagagtttttttgaaaaacacaaagtttagtaattaaaaaaaatgtacgcgtgaaaaacgacaaacataaggtggaaaatatggctgccgaacagagccaaaatcagttgcagtgtgcagaggtgtcagtgactcatggattagacagcatgccaccaaaacagagaaaaaaagagatagcaatacgattactatgctagtctcactggcacgtgggccatgcagctgacgcagcacagcaccgtgtctcaagggctgtccagagtttgtgtgggccacaaactaactacgcacagaaggttcaatgggcccatatttgcaatccgttctggcccaatacctgacagcccacagcaagcccaccagagagctgggcccacgcgtcagttacacgtagcgcgtgtcccctctcgtttgcctccgaatcgggtaaagccgccggtggacggaatcgacggcggagatcccatcccttccccttcgccttcacatattccttccccctccaatcccaacacagcagcagcaattctttacttaccgtctttgcaaccttatccacctcctaaccactcactgacatcttggacccacaccccagatctagccctccccgcgccgggtataaaacccgtcacgtttccccccatcctttaccaatgcccccgtcgcgagcgcgtccacgtcagcaaagtccctgcatgacccaccggtgacactgccaggtgggtccttcttcctcctgggcccacagtcagtgactacgcgtagcggacgggaagagaaaaggtaaattatttactcttacgattacgctaatttcctcgcgtcctttgcttgcttagattatccccaaaaaggaaattattaaactcaaaagactcttgtattttctctccccttggttttgaattcgctcgccgccgacgcgggtggcttccgtcgagaagcttctggaagcttccgggaccggggcgccgtcccccgcctcggcgttcgtgcgtgcggcggcgaggcggcccgtggctcggcgatcgatccgttgcttgcttgcttgctgcgggaggaaaggtattcccctctcgttaggattcgatttcccgtacacgttacgaatattagcttgtggttttagatgtggattaggcggctgctgctgccgtagtagtagcggagctgcgatttctgcgcttcggtggtgtttccgctgctgcaatcgccccgcgcgaggtggcgttcggttcaaagctgtgcgcatttggggagatttgcgagtcaaatgtagcgattccctgtgtgctccgttgatttatccgcctaggtaggcattagactcgtctgaattgcggggagcggttttggctgttcgtttgatttctacctgtgtgcttccattttattcgttttcaaacttccgaaactaatatatgttttcagcatgtttaggttatttggtttggtcttgtctgtactagtaatcatgtggattcctcctattgcttgtagtgcttgtagtaatcaaaagggttcctggaagttgctatgatgctaccatgattgaacactgcacttttaaatgcacaattgatcatgcagtaggaaaggagtgcttccatttattcatgtctgctgttctgcaattgctcctgtaaatttgatgctcatagtccatctttgttttcctaggccatttttgctcaaaaaaactgtataccccatgctctgacagatgtttctgtgaaatagggctcaagatggtcgtctcaatcattaccagagccttaatgtaagtagcagcggtagtttccttttaatttctggaaaggggcaatgattttggccacacctgttatgtgttttgctatcttttgattttgcagacttattcttggatatgcatacccagcctatgattgctacaagacagtggagctgaacagacctgaggttgagcagttgcggttctggtgtcagtactggtttgtattggacaccccctttactttagactatcattcttggatttaattctctacttgatcacatgctcagtgatgattttacaggattttactagcagttctaactgtttttgagagagttggggataattttgtatcatggtaatgtggccatctgttattgtggttttttttgtggttgcagtttggagggaactttcatgcttgctgatgatgattttgttatcatacaggttaccaatgtatagtgaagcaaagctggcatttatcgtgtatctatggtatcccaagacacaggtatgaatttcttatctctttttaatttcaaaatcgtatggcttttgtaatggagagcattttcagggcacttcctatgtgtatgagtcattcttcaagccgtacattggcaaacatgaagctgaaattgatcgcaatctacttgagttgaggactagagctggtgatatggcagttcattacttccagaagatcgcagactacagtcacacaaggttctatgaaatcttgcaatatattgcttcgcagtcagaggctcaaagatctcgtcctcaggtacttcagaaaactcttgaagttgcttgccagccataatctctcagttacttccatttgctggtggaagttagaagaataggtctgcagcatcgtctctctcttgggcagatcggaactagtaatcttcatgattcatgattgtatttaaaatttcagaatcaaatgcatgcagtaacatacgcattcagcaaatttgacatacctatgaggttatgacctattggttctatattcctttcagccctgcatttttcacatcccatgtctaccattaggtatttaggttcatatttgtgttgctgttgatgagatgcacaatcattttcataagtaagacttagcttaatcgtggtataaatgtactaccaagcctttctatggaaaggtctgacatatgcatttcagtgcattttttcttcttagtgcttgaagaatttgggttactatatgatatatgaatttgattctgatcctgtgggatatttactgaactaacaatgaaaatccaacttaaaaataatatcgcgaggttccagaaagatagttaacctaatgccatttcagtggattattcactatttctctatcagtggtaccttttttgagaacttatgtgcagctgtttgaaaggctgtgtttgactgcttgttgttgagaagttcacgccaactgaatgtatatgtccggctacgtgatcaccatctagcgacttacatttttcttgtttgtttcatcaatgggtctgttagggggaaccaatagttttaaacacagtagcttattttttaaaatctaaattaagcattgttcttagatgtattagtaatatctgttgttagctggtgtcctttatttctctggattatttctgagcttaggagcttgagctaatttgaccatgctgaatcaatttcttaatatggtagttttactagttcttgttgtaaggtgctggaaagtttctaaaattgcttcagcaagagaagcacaaccaagtggatccgattcatttaggtcgtgtgttattgtggttatcttttgccaagctcccttagcagtgactcctaactagggaagttattttgcgccctaattccatctgtgtttcaaacatgaccctttattttattatcttaacttggttaatcatggtgctgattttaccctccaaataacctgggtccacgaaccaattgttttttgggtctctaggaataggatgtggaaccttgctgatgtcgaaatggacctattatatgtttattaggagtaaatgtataggcgcttcatagttctgaagttgctattttttgtgttccaacctttcttgtcttgttattttaccatatttataatttttttgactgtttcatataaactattcattttgttacatggaaattaccgtgtatagtttggcaatgcaaatatttgtggtcattttctggcagggttcaagttgaacatctccaatttatttttgcttctagcaaagttttttttttttttgcagggatgcttctagcaaagtttgtttcatgcacattttttctcatgttaaattattactaccaccatcacactcattatgatgttacactactcgtcatagtactaatgtatgttcagtttactgacaaagtaggctatctgggcacagtttactgacaaagttggttaaattaaaactaccaccatcacactcattttcagtttactaatgtatgtctagtaaagttgttgacatgatgcatgattgagttgttatctgagcacttagaggtgtaatatccgcttcatgtttctcagttgtatgttcagatgattgtttttgaactagatatttattactaccttcatattttaatgtatgacgccgttgactttttatcaaacgtttgaccattcgtcttattcaaaaaatttatgtaattattatttattttattgtgatttgattcatcattaaatgttctttaagcatgacataaatattttcatatttgcacaaaatttttaaataaaacaaatggtcaaacgttggtcgaaaagtcaacggcgtcatacgttacgatacggagggagtatttattatcgcgtgatgcctgcatcagcttatatctgtgtagagctacacctgactctcaacgtctctgtttctgcaggcacagcaacaccagcagcgtccaccacctccacggactcggcaggtgaaccctgcaccgccgcctgttccttcaccgtcagcgcctccgctgccgccacagcctccgccgccaaggaaccaagctcaagctgacaaggccccaattccggtcgcccctccaggcgccgccgtgcctcctgcacagccacagccacagccacctcaagcaggcgctgaagccgtcacaacggagagcaccgaggcgacgcaggcggccaatccaccggcgacgacggcgagcaacccgcatcaagcgccggtaatacccgacgaggagacgctcatccaggaggcgatccggatgacacggagccggctcaggaggcgcatgggtggagcttgaactggaccgccgccgatgtacgtaaagctcccacgccacgggatcatttctcgtcatacgtttcgctctcgacgcagggtgcacactgcactgcatgcacatcctgaaatctgaatcctgtgtaaaaaaaaaaaaacaatctgaagcctgttggtttcgtttcgcggtttcgcaattgtgtatagatcccaccaggtcaccaggaagtagaacagtagattgatggacattgtgatggcacgagaagatcagtaaccgagtacattggtaaagaaagaaagatacttggttggtagatgatatgtgaatgtgagcaacttaggacaattgtccctcatctccttgccctgtgacaattgtcctttcctccttgccgacgataagatacaagctgattcttttcttttctatcactctcaagatactcttcggcctgaaaaaattgaggatatattgccaaagctgaagtcacatctttgtcacacacgagaatctcatggtaatgcaagaacttcattgtctgctaaggaaatcaaagtttgcacttagtttcatccctgccaatatgataccttcatatatttcctcataaagtataaggccctgtttagtttgcgaaaagaatttttttttggatgtcacattggacgaccggatgtcggaagcggttttcggacacgaatgaaaaaactaatttcataactcgtctggaaaccgtgaggtaaatttttttagcctaattaaaccgtcattagcacatatgagttactgtagcacttatagctaattatggactaattcgtctcgtgactttcatgtaaactgtgcaattagtttttctttttatttatatttaatgctctatgtatgtatccaaagatttgatgtgatgtttttggggaaaaaaattgggtactaaaccaggcctaaatcactccatatctaaacttccgaggccatctttcagcagacctagataaaagaaaacaacaacaacaaacgaacgaaacttcgacctcgttttatatttcgtttgtgaacttgtgatggcaccccaaaaaagggggaaaaaatgtcaggcaagaagccaacgaaacttcgacctcgttttatatttcagaactaacttcgacctcgttgatagacgatgcttcctatgtgaagatcagctacaggtttacttttgtcattctcgaaagtccctatctgtgtcgctctagttgaaatttcgccaaagcactgagaccaggagccaacctggatcaggtcccagctagctgttgatggcaacctggttggctgcttcctacaaccttatgttccattccgttgtgccagatatttagacatatacagtacttcatccgtttcacaatgtaagtcattatagcatttccctcatttatattaatattaatgaatctagatgtctagatttattaatatcaatatgaatgtgagaaatgttagaatgacttacattgtgaaacggagagagtatcatttgttagaaataataccattaattgttctaaagtaagcgtaattctagaatgtatgcattcaaaccttgattccttaaatcattaataatatatttgttatgaaaaaaacttccttctgattatattttaaataaattttataaatatataaaaacaataatgagacatgtgcattgtgtggatgttcgaaatgacaaagaaaataacgaagccattatagtcgtcaagcttattttccccacataactaaaacgtggttgcaaatgtgggttccatattatcacgtatactcacgtgatcatgtcacatcttgatggggaaaaaaaatcaggagccgcaccgactcaaaggttgcttaggcttcgttcgattgctctggagggggagtctaaaattaattaaatattaattattacaaatttaagaactgaatttatttgtttttaaacaacttctatatataaatatttttttaaaaaattaaatacaccatttatcagtttgaaaaacatgctaatgaaaacgagatagttgaagtttggagttgaagaatataacatggccttagtaggaacttattgttcctttctccgatgatcttcgacctgaagatgggccaggaatgtagtcaaaattgtacatattacccctttccgtattctcgttttataaataggccctctagaaaatttattttaaaatagacccttaactcaacggcattagcaatggaccgaagtatgacacatcggtgttacaaattttgtcgttgagaattgagatcctcgctaagctagcacaaactctatgtcgaattgtcaacaggtggttgccgccaaaaacattggcgcaaacattatacataatttgagaaattagcttacatttagccagaaaccaacgagtgaatggtaatttagtaatctgttgattacgtttacataatatttacatcattacttaagggcatatttgttggttaatctatcagtttacgtcaagctcaggccagctcagtaaggttcttgtattttgatgtcaaggttgatgctgggtttatttttagaacaaatttttagtcggtctatttgtagaacaagaacataagtaggactaagatgtaaaaattccggggtctcgtgaatctgtgatagtgataaatctgtcctaaattgtaatgaggacaagagttcataaatctaaaataggtagtacagcgacaactccccctgcagtgtgaaaaacaacaggtttatggttctatacgtactattaataaacgtgtatgcgcgtgtgaaattgggcataaatacattttgttccagaggaatttggttcagatataaaaggtacacgcatggtgaacctcacgaaatggaacactgttgactgaccagtatgtacagtgcgctccatgtttaacatgcacatgaccatcttgaccaaaactagccctagatactacaaacccatgattgatcttaattaacggcaattatattctctgccctgtttttaccattaacgcttaaacgaaatgttgcgaactgcaagtcgtcctggagcatctccaagctagacatctcttaaaccttgctctccatttacggtcccatctttttacttaatcacggaataagctaaacgatatatttgcaaacgaaaaataatttatgaataaatatatatatgtatatgtatgttcttagtgatttaaaagtataggctaaaaaataaacttcaatgaaaaactctaaaaccaactctaaatttaaagttaaaatttcaaattttggctaatgagtattagcatatcatcttttacccatttgataagctagctagtcaaagattcatctctatatttttcatgtgctctaacatgcaatatcctctccaaactacactcttcattttttttgtgggatccacatttcagtctatatctcatttttccttctcttcagcacaaatgagtgatttgaccagctattattctggcttgctagatttggccagcaaaggagtgattttactagcgggatggctcggtcaaccaaatatagcaagtctcttggtttgtttttttctcggggtttgcctaattttgacgtgacgagagatccacctttcttggagatgctcaaatttttagttgggtgccaatttttttaagtatatggacacacatttaaagtattaaacgtaaactaataacaaaacaaattacagattccgcctgtaaactgcgagacgaatttattaagcctaattaatccgtcattagcaaatgtttactgtagcaccacattatcaaatcatagcgtaattaggctcaaaagattcgtctcgtaatttacatgcaaaatgtgcaattgattttttttcgtacacatttaatactccatgcatgtatccaaacatttaatgtgacggaaaagttggaagtttgatgaaaaaattttgaatctaaacacggccatagtaatgcagctttcgatatttagactgttcggagctctttgttcccaactcctcttttcgttttacgcgcgcacgtttttcaaactgctaaacggtgtgtttttttataaaaagtttctatacgaaagttgcttaaaaaaatcatattgattcatttttttaaaaaaatagtaaaaacttaattaatcatacgctaatggatcgctctgttttatttgcacacaacttgggggttaggaatacgggtttccaaagtccaaacgcagccggctggttgacgaagatgacaatgtgaacgcagtggagtagtgcgtggtggagggacaggagggtgcaacattgtgacatatgcatgcatattcagtagtagtaaggtggcgtatttggatttcccgtcaatcggatctttggatactaatctgagagctactaattgtaacatagagtacttacaaaactaattgcaaaaaataagagctaattcatgagacaaatttttttaacctaattaattcataattaacacatgtttactgtagcatcacatatgctaatatagattaattaagctcaatagatccatctcacgaattagtccaatgttatgtaataggttttgtcattagtctacgtttaatgcttctaattagtgtcacaacatccgatgtggcagggattaaaatttaatccctggatccaaacagagtctaaatctccatcatctagtatatgtttaggttggacattgactgaatagcagaggttatcgttgactctgctctggttcaattaaacaaactaatgttgtatttaggggggaaattatgccaaaattttaaaattataacaagaactcttgtatttgatttagttaatgaaattaaataagtttataatattataataatagtactttttattcaattctatgcatagtatttgttttgttttgttttcaaaataagtgtttgagaaataattgatgatcggagttttaaaacataaaatattattttttttaccggaaaaagtactatacaaaaccaacactgccagccatgtgtgtcatagcaacaggcctaacagaagaccgatggatgggtcagcggatgcagcaacaaatcggcaaaaaatggttccttatctccaggggtatcccttcgatttcgctaattacaacgggaaattccaaaagaaaaactgaaatgatagtagaaatcacgtggtttactgatcattggacagtgggtgatggcactggcctttgttcattccatcgaaggtgacagtgaccggccagcacctgtactgcgagcattttcacgtgttcatgtacccttttattcataaaaataaacattctaagtacttcaaatttattacaaatactaaaatatcatagtactattcgtcttataaattacttcttatttaaatttcgtttatcctactgtcgaaacaagaattcgacaataataaaatagggtagcgcacgagacctaaaagtgaatggatgcggagacaaggatttagacaggttcaggctctctcgatgagatgtaataccctactcctgtttggggatttgaatccgtcgggtgtattatagatctgacgatctagttgtgaattataccccctagagggcctcctgcccaccttatataggatggggggcaggattacaagatagaaaccttaaccaatacgatatcagtttcctaaatctactttacaatattatcaaatcaggactttaggccgttccataatatacaaggaaacgtaatacccaagtcatgatccgttacatatttcataaatataagttatcccctataaccagtcggataaccataccgtgtgtgtatgaggtacccataatctccacacctacatcaacctgtcctcccatcccctatacatttctcattaaatgaggagcgtcaaagttctatcttcttgatcttaatatctacttaaataagctagaaatgcttatatttgtggatgaaagaggatatatcatattatggggatgtttggttattaatgagattggttgacaatatgatattgaatcttatcgaggtaaggtagaagaagacatgaactgattttatgttttattgatttactacgcgatgactttattgaaaaagatcatgctcacaatatcttttttcacttaggactagatatccatattatcaccattagtattataggagtgtttggttcatagccacattttaccaaatgtttagcaaagttcaatcaatctggtctaacgtttagttttttatatcgcttttgtggcatgctacaaaatccttcctaaagtttgtgtaattcaataaggatttcctagccacacaaattatggtaaagcagcacctcagttcaaaacgtttagcaaattgaaacatgcagccaaacaacccaacccaataagacaatgacgccgcacaacgtacagttcatatgggaaagccattttaccaaatagtgatatttttataatgaaaatttgactatcaaaatatgacgtcatacaagtatcataattacttaacacttcacatatataagtttctcaatatgtagattgagttttgagttagaattttcttttggaatgatatgacacaggagagatactcaatattcatcaaaatatttaaatattttttataattaatttgttcgggagtttataactaattaaaccacctgatcagcacagtcagcaactcagcattattcaagcgcttgtggatcccacacacacttcccatcttcgatcttcctataaatgaagtggccatgcattccactttttccatcccatctaaactcgcttgagcttgatatgccacagatcaaggcttagaagagatagctaattactctacgctaattaatccagcagcttagcttagcatagcttatctatggtttgccacgtcttctcgtccttctcctcctccctaattcgtgtgctggaggcgccgctgctccttccagctgcttcggcttcttcttcttcttcttcttctccggcgagccggagcggtggccgccgccgccgtgcagcccacgtccgcccttcgccggcgatctatcccggccgccaagaacttgcctctcactcatccatgctacccaccgacttcgacatcaaggtaagctacgtaccctaattaaacaattatttaggtagctactttctctattttgtactattatagtcattttgttttttccaatcagaatgtcaaatatgtttttatgctactcccttcgtagcaagagttagaaatattttatatttaagttcttttgcaaataagttgttactatttgtaagtctctatatatgcaagactttaatagataagtaaattaaatgtttgatcagagatcatccgatgagtcatcttaatactcattgcatttgttgcatacgtgtgcatgcaattcttgatctttgctatatgtagaataagttaatttttctttgatcatggtgccaaaagtaatatgtataatttttatgaaagaagggagctagtatgtttgttttatattaaaaatgttattaaaagtttaacttacataaaagtcaaaacgaacatgttatcaaatagtgaaaattaggtagctaataatgaacaccatgcatgatactactaatcaatatatttgattaattgctaatctagctcgtgtttaattgatctgcaggtgttgattgagcggcacgaagccctgacggacgacgtgcaggagatgctgcagcatcaacgccggcgacaccagaagacggcgagcggcggccgggagcggatagccaccgtcgaccacctcaggcgcctctgcatggaccactacttccaagacgaggtcgacgacgccatggacgcctgcctgctcgaggagctcgcccatggcggcgacctgcttgacgccaccctcgccttccgcctcatgagagaagctggccaccatgtctcagcaggtgagatgatcactctttatgtgcgaacgcgcgaaagggttgcacgtcaatactttagaagaaaaaaattatagttacacaacgcaatcagctagatcggcttataccaggagaagggagaaaaagcaaaataaaaagctgaagcttaaaaaactacagcggctaaatacaaaactccaagcagttgagaggggccgagccacgctacactcccaacaaatcccaaaaacggcaacaccagctaaagaacacagatggccctccgagggtgtgagatgatcacacactaatgatcatatatcatatgttacagattaatcaatcaactaaccatgattaattgtcaattgcagatgaggttcttggaagattcacagatgataatggcgaattcaggctcgattacagaaaggacatcagagggttactcagcctgcaagacatatcacacatgaacattggacaagaagcctcactctgcaaggcaaaggagttctcaaccaggaaccttgaatctgccatcaactacctcgagccaaatcttgcaagatatgtgaggcagtcgctggatcatccctaccatgtcagcctgaatcagtacaaggccaggcaccatctcagctacctccagaccttgcctatccggtgcactgccatggaggagctcgcacttgcagacttccagctcaacaagctactccatcagatggagatgcaggagatcaaaaggtacatattacagtacatacattattgaatcattgatatacatactagctagctagctactccccccgtcccaaaatataagaacataggattagatgtgatattttccaatactatgaatatggacaaacatcatgtccagatttgtagtgctataaaatatctcatctagtacttgttataatttaatttttgttgtaacaaaacaacaatgattcttacttagttgaaacacacttgtatcgaacaatagtacgattcatagaatcatagaaacttactatctccgttctagaatgtaaaaggctttagtgtttaacacggtaatcaagaaagtaggtagaattaggtggtgtttgaatctcctgaagacgaagatgaagataaagattaagtgtttcatacaaacttgaaagatggattgatctgattttttagaacaactttcatataaaaagttttcgtatgaaacgcaccgtttagtagtatgaaaagcgtgccaatttatccaaaagtttatctacttttttagtggattcgaaagggaccttaaatggagagatgttgtgattagggttgtgaacctataattggttggaaaaagaatatcaatggagaaattataatatgttgggataaattcttagttgtagaaaggaaggaatacatgcatagtcatagctacttgctatagtttaatttcctgtattaattgaacaaccgtgtttcttcttaattagttagttgaaacacacttgtatcaaacaactgtaagaatattcataagtaggagtagtaccttgctcttccatgcatagctacttgctgtaattaatttcctgtattaattgaacaaccgtgtttcttcttaattagttgaaacgtgcacgcttgtatatatcaaacaactgtaagattcatagtaccttactcctagctacttgctgagtaatttcctgtattgactgaacaacagtgtttcttcttaattactttattcattttataatataaaagattttagatagatgtaacatatactagtacaataatgaatctaaacagtctgacacatcctagtaccagattcattgtactaatatgtgtcccatccacctaaaatcttttatattataggacggagagagtatcaaacaacaatgtgattcgtagtaacttacatgcatgccaactacttgctgtattaattgaaacaacagtgattcttcctaattagttgagcagttgtatcaaacagcagtggttcatagttaatttgctggattaaactttgactatgagtgtctgaaaatgataatatgaactatgcatgcagatggtggatggacctgggattggctcaagaaataccagttgccagggaccaggttcagaaatggtttgtgtggatgatgacagccatccagggtgcctccttgtcaagatgcagaattgaactcacaaagatcgtctcctttgtctatattgtggatgatatttttgatctggttggcacacgtgaggagctctcctgcttcactcaggcaatcagaatgtaagtctcagcttaagatagataattaacatgagtcttcaacatacatttgattttccctattctcttttttcttattcactggattatttgctctacacatagagatatgatttttcaaaaacttcttgtctagctattttatttcttagactacttattactaatataagccatttgttacatttataatatttaatatttaatttgtccctataatcaagtagatatataccatcaactttcattcgcgaataatctatttagaacagagccttaatttaaattgttattatgattataagtaacaattaataatgatttttttacaggtgggaccttgcagctgctgattccttacctagctgcatgagatcatgcttcagggctctacacacagttacaaatgacatcgcagatatggtcgagagagaacatggagtaaaccctatcaatcatctgaagaaagctgtaagtaatttttcgtttgtgttagaacatttttttaaaaaaatctcattcacaacgaatttgcagcaggactgaccatgcatatgcaatgcaattgactgaactttctttctaccatgtgtatcttgtgcagtgggcaatgctgtttgatggattcatgacagagacaaaatggttgtctgctggccaggttcctgactcagaggaatacctaagaaatggagttgtcacctcaggagtgccacttgtatttgtacacctgctgttcatgctagggcatgatgtgagccaaaatgcagcagagtttgttgatcacatccctcctgtcatctcctgcccagcaaaaatcttgagactctgggatgacctgggcagtgccaaggtcaatacctttttctcaccatgtcaaacatgctactcccggcccttcaatttctttaatatagataatgtcgttgtcttctgtacatacatcgtctggctactgtatttggtttatactttaagtatgacttacattttttttcatatttacataattttatttctaataatatgaatagttaaacacatgttaaaaatcaacgatgtcatatttattaaaaaccgggggaagtaattactacacacttatacgtagcaaattaatcttattcttctttgaaatcttattctcatgttttaaatcagcgcccacacacacatcaaagcaatatggtatctctgatatcttctctaaggattgtaaaaatataattattttaaaaaaatgtttaaagttgtatgggagattgatctttgctgggcctatcgtgaactgaaaatgtatgaaataaaaattgtaggatgaggcacaagaaggattggacggatcgtacaaggagctatacctcaaggagaacccggggctcgccgctggcgaggcggaggagcacgtgcggcggctgatcgcgggcgagtgggaggagctcaaccgggagtgcttctccgctagccccagtagatcgtcgccggcgacgaccttccccgccggcttcacgcaggcggcgctcaacgccgccaggatggtcggcgtcatgtatggctacgacggcgagcggcggctccccgtcctcgacgactacgtcaggatgctgctcttctgaattcgatcgattgattcgacctgaattttaatttcatccatgtatgaacctcatcatcgtccatgcataatggcgtgtagagattaattgtggattaggtctttgtaaataggattatagttagttgagtgagggagatagtactggtcgattttgtagtaaataaatatgatgaatttttactccctccattatacatattataaggtgttttagtttttttttcctatgataaactaatttcaaattgaatgaatttgggcatgtaatttattgccaaagtttcattttggattactctttaacttatgtttttattttggaccatataattctacattaatttgttgcactttagaccacttcaaaccactttctgtaaccatatatcaactctagcactgtaataaactccctcaccatgctcaagccacaattgataattttgttggcagagtggcgtacatggctagagaaagccttaggatgataaaaaaaacaacaaatgtaaatttacctagtacaaaaatgaaatgattagtcaaagggtggttcagagaaaagacttaacaataaaatgtggtaaaaaagtgccattcactctctttaattttcacagaaaatatagcaatattttttacacaaaacaaatatatatttaatggtgaaatgtagatggtgctatgttttttcataactttgatcgaacttgaaaaaagtttgaagttaaaacaaaccttttcatgccctgcagcatggaacatagagacgcgcaatttttttttctaaaaattatgggcgtgtatttggacaatggatacgaataaaaatcatcaagagccttttgcattcatacgagcgcataataaacttggagtcgaaatactaaaaaatgtgaaaattgaaaacaaaaacatcaatatgaggatgacaagtggggcccaccgggggagggggtcctacatgtcatactggtcacgggccgtgctgccaagctgtcaatcccaaattcacctctcgccgtcacgcgaattccggcggcgacccacctgcccggcggccggctacccccgccacgcaccaccgccggatcaagcctccctgccacaaaccaggagctcttcctcgccggcgctctcctcatccacccgtagcaggtgaccatctctccttcgcgcgctctcctttgcaagggcaaggaagccctaccttgcttggatgacttgaatccaaaccggatctcgcttgtgccgatgtgttttggtttcaatcctctactggtattcgcagctatatttccattcccccaccccgcgtttagtccccatcgcgtctagtatgacgatttttttttttaccatagattgggggtttggaagtagattgtatgttggattccactctgttggattgaaatactctaatcattgtttgcagaacccagattggtgaagtttccctggtgtggaaattttttcattgtgctcttcaatgttgtttgtactatcataaacatcaaaagtagttcagattctctgctgcataattcacactaaatgtcccatcacgaaaatatcctctgcgttgttagtgatacactgataatctgatatacatgtgaataggtatggtatagttatctgcggtagaatactatggaacccatgcctaggcttatttttgtgtatgatttggattttagagaggccctggaaatgtgtgaagtggttagaaattttaggtgtaactgtaattcacaggctaatgttctatgtatgtgtcataatcggcttctgaatcttttcaacactgaatggcaatataaaggtggtgtaattttgactcaccaatcgtgaatcatcatggatttgtgaaccatagcattttttgtcatcttttctgcattccagcctgtgactaacattgtatcttacatggaatttcctggaatgcattactcaatctatgatctgcaaaatgaagcccaacagtttcagttgattttgatatttccaagatgcatttctgttaatatttttttatgatactcagttgacaaaagataatcaatcatattcttttttttgttcaaatttctgtcgatgctgatgtatgattgctttgttattttctgtgtaggaatggagaagtatcacagcaactcccgatttgctcccttcagagatgctccatttgctctccgtggtaagagattttcagtgatttggtatgctatctgtccttctgacgtagttacatgatatcaaacaattacaccacagacacactgaattggtaatattggagacatgcatacatctttttaagtatattcttgtatgtaggaggtaaaactgactgacagttgaggtatcccaaggctggaaactacattagagtgtcagtctgccaaatagtggttcagttgagacaagtctaatactgtgctgatttatcaccatatatagattgtctgcatagctcgagatgatcaaacacagccgtgtagcgctggtcatttattatctgaatgcaaaaggctgttgctggtcatacatgatttatcttttatggggacaagagtttatgcgtgtctgacatgactttgatcacttccggttggatataggtgaataattgatgtgtagttttagtgagaaacagccatctctagtgaatctttagcaagcaactgctaattctgtgtatacatgtatagttcacaatgccttcaatcagatttggtaaaatgcaatcaagaaccccccccccccccaaaagttttttgtgtgctcttgctctatgtatgtttttttttttttttgtttacagttcatttcacacaaccaggaattcctcacatttgttgccaccatactttcaggtgcccttggtagctcaggctcatctttcagcagcatcgacagcctcagacgctcctcaacccttgagcaagctagggggtacacatctcgtcccctaggagctgtgcggccaaagatgctcccatctggatgccgacccctgcacacaagccatcctctgtcggctcctgttgctaaccgccccctgtcaccccaccttcctctgaagaagccacagctgagtgctacattctctatctcgcaccgtatatttggtgctgcgttgggtgctgccattatatccattcctctcgccaccaagttcagcctcatgtttgatgtctgagagagaaatgtggtctgcatgatgagaaagaaatgctatatttctgtgactatctcagcatctgaatttgccttgcaatgcaactgtagctgccgttggaataatatctttgctgtgcttgtagacttgtgaataataaacaaaacatgcaatgaccatactccctgtgagatatgatgttttatgctaagtgttaattttctctaccctttattgttctgctgccttgtggaattccatgattcatttttctcctggcaaaaaatgcttgccatgcgtgcaatttattcactatgagtttgcgttgtttgtataatgctccagttgagctgtagttcttttgctgctgcaaggaagggttggagacaattgaaatgcccaatgagcttatagtgctgaattcaatgtcaatgatcattgccaaaaataaaaataatatattttagtatgtgtaaataatccttgctgaaatctaacataactatttgcacttttttttgtatgtacatcatcattgctaaaatctttaataagtatttacactgttttttttttaaaaaaaagtgtttgtctctgttattagtagggggagcagggtggtagtacctggaaaataaaagttcggtgcaatgaatcgcgcggcgaggtcgaggtcgccggaggacgcgtcggtggcggcggcgcggaagctgcacctcctcctccgctcccgggacctccgcccggcgctctcctacctccgcaccctcccctcgccgctcaccctcctccccaaccacgccctcaacgccctcctccgcgcgctcgccgccgccggccgcgtccgcgccgccgccgccctcttccgccgcatcccttcccccacaccgcactccttcaactccctcctcgccgccctcctccgccgaggccgccgccgcgcggcctccgcgctcttcgccgcgctcctccgctccccctccggctcccccgacgccgccaccctcaacaccctcctccacggcctttccaccggatccccggacccgtccactcccgcgctcctcaggctcttccggttcttgcccgacacctacgccttcgcgccggacgccatctcgtacaactcgctgctctccgctctctgccgcgccggcgacgtgctcaccgcgcgcaagctgttcgacggaatgcgcgtcggaggagaagaaggcagaggagctgtctttcctaacgttatcacatacacgaccatgatcaaggcgtactgcgccaagaggctcgtgaacgaggctctcgcgatcttcaagctaatggttgcggatggtgtggcgccgaacaggatcacatacaacacgatggtgcaggggttctgcgatgccggcaggatggagctagtgaaggaggtgttggagatggactcgtttaggccggacacttgcacattcaacactctggtggccgtgcattgtagggaaggccggatcgaggatgctatgaaggtgtttaatcagatggtggagctccgtgtgagacgtgattctgcaagctatagcatggtcatccgggtgttgtgtgagaatggggaatttgggcaggctgaggagcttgtggatgagctcttggagaaggaggtgctcaagaagagagggggttgcacgccgctcattgcagcgtacaacccggtttttgtgtacttgtgtgagcatgggaagacaaagaaggcaaggatgctgtttgggcagctgctggaccggaggagcaaggtcgatgttcctgcattcaagacattgatccttgggcattgcagagagggtgatttcgaagaagggtatgcattgctgctctcaatgttgaagcgggatcttgtccctgatgatgaatgctacattgccgtgattgaagggttttcacagaggggaaggatgaagtttgcatgggaagccttgcacaggatgttgaatagcggtcttcggccaagcacaagtacttttcactcggttcttttggggcttttgaacaaagatggttgtgcaaaagaagcagctgatttgattgagataatgctagagaggaagattcgccaaaatgttgatctttcgacaaatttggtagatacattgttcaggaacaacctaaatgaccgtgcttacaagattgttacatctctatatgaccatggctattacatcaagatggaaaagttaatcgcaaacctttgcgaggaaaagaagttcatagaagctgcagattttactttgtttagcttggagaagtctcagaattttggtgtagccattccaagcatggttctggatggtctttgcatgactggtagagcttcagaagcattccggctgttctatgaactcattgagaacagaagtgctttggcttctgtcgctgcacctcgtagtttagttgcacttcatcatgcactggaggaatccgggaaaatgaaggaagctgattttattgctagacagatgagacgtgcaagtgccagaataagggaaagaatctagtgggttgctttgtcccaaggagcatttcaatcgcatgccctttgcttctccaaacaggatggactaataagtgtgaacttaaaagaacgaacaggatgcagaaactgtgcctgatccactgccccataagaaatggatcaaccaactgtatgatgttagaatgcagattaattcagcagatatccttttttttttcagggaaactatggcgggtggattagcaccggcctgaacatttattgataaataaagagatagttacaaataaagataatttacatggaggaaggagaagttgcttgagaattcagaaaatacagaggggggaggatggagtttaagaaattcctatgtcactaagattgttcatccaggtgttcagagcggggcgtagatgctccgggcagcggtgtacccataattcagcagatatccttaaaatattggtccaatcaggactttgtatagccaaacaatcaagccaactttctctgtcactatagtatcaccgatctggatcatttcttctcaaggattgatatctttgggaggaaatgaagtgtgggaagaccagatcacaagagtactctgctcctggactttgaagggcagtagttgcgggagaccaaagaatccggctgaaagaaacatattgtgaaaatgtactgctttccccccccccccccccccctaaatgcatgaggcanagctccttgccctttgggctcaaaaaaaaagaggaaaagaagaaaagtggggaatttaactatttgccacttttacatttgacaattaaccaaatacccttcttaagattgtacttaagaatttgccattagagagagaagcttttgtaactttttgccactttttgccctgtggagtgccacatgtgcatgccaacatggaccaacgtgaaaaatgaccaacctaccccttctagctagtggttagtttctcagttgctaagcctgtccgcattgaatcttagtcataattcattcactggaaagataccaagagaaaccagcaacctgcccaatcttcccattttacacttttaaatttataaggcaacaacatcaatggcaccattcatgttacagtcagttcattaactttttgaggctgcattcggatgtcttttttctaacttctactcacagttattaggactgaccagaccggcggttggactggaaaaaaccggaaccagggcctccgccggtctgagttctactccctcatttttttcgcacgtttctttaataactttttaaataaaattaagttactttaaaaatatatattaatctattctttatttattaaaactcaaactaaattagtcatgcgctaattctttgctcagttttacgtgaagagagaaatatttccaaaccatgctatcgcacaccttaattgagctcactccaggtggcaccatcccaacaataccagccaaattggaataccgtttagcagcttgaaaaacgtacacgtgaaaaacgagagagatgagttatgaaagtgaacaaaagaactcaatctaagtatcgttttgaaagtttgttataaccatctcagtggatctattacttcaaatattgatttgttaactgatgtggaggtactcggtctttaatatagtacctcataaaagtgaacagcatccataccgatgcaactgattcgcgaaagcaatttgtccaaatattattcctgactcagcttatattacagacattactaacaagggtagattagtcatttcgtgtgcctggtccatgctggcatgtatatgtggcactgaacagtgcagaaagtggcaaaaaattacaaaagcttctctctccagtggcaaattcttaagtgcaaatctaagaagggtatttggttaattgccaaacctaaaagtggcaaatagttaaatttcccaaaagtgtgaggcaatttctatatcaagcattattattttggaagacaggttggctaacttaccatcagtctgcctatttctttacagaggagtgaccttagctcgactagcaaatattcctaatactttacagaggagtttccttgccagttgccacaagatgtattggttgatgtgtctgaacgtaaagaatcatactacaaaattccaatttcacattgtcgttctcctgttttgatgctgtttgtgagttgtgatagccgtgactcagtttatgtgcatgcattcagatactttgggggctcaccacagaactacacagtatcctgccaactcagttggaaattgaaacactgaaatgtgagaagtaggagatgatcataagaacattatgttccttcacccagttatttagcacagaacacatttaatcctactcggcgcagagaatcaatggaaaacgcgtgatgttcagatctcacagttccaaggaaaccacgaacaggtatataacacgcaatcacatcaaacgttttaagtgttcaacacactcgaaatactgagtgaattccaaggttactaccataacaaacagttctggtatcacgtctctagtactacagagatattcaccaccacaggaaagctgggtaccgccacaggaaagctggattcagcatggtaggcagggagaaacacactatttcgtgaagcagtgtcactcaatagattgcaacactcaagtaatcccctatctgtgaaagaacatagcaaataatcaattgatttttgcctcagaagaatacattgtaataacataatacagctctgacaaatacctggaatcctagctctgcaagagttttagcatcatctccccttccatggccataagagaaggttgaacccaccttcaatcaatatccaattatataagttatcacaaattgaacagttactggtttggaatataaaggaacatgggttgtacaagggaatttactgacatatttagtggtttaatggcacagatagaacttgtaacaagctacgttttagtacagagacaattatcacgatgtgactgaagtggctactggtaagtggtaactacatggggcctagtggtgtaccaatgacatgtgttaggtatgcatacctgagtttgcagaaaagagattttgatgtcattggaagcatgtcatgaatataagcacacaaaatagtaaccataactaaaactaatagcccatgtatagtgaccaaactaatagccaacgtatagtgacagtcaaagcaaaatccaactcattcacgataataacactcattccctattcagattaagaccaacgtgctctgcattttttccatgtttgtgtatcagaggaagaaaaacaggatgagcagaagaatagtcacaatggtcaatggggataaactctcacctctttgacaacgaaacgaccatgcttatcagggtacacgaaagcaaaagaaagccttgcatttctttttcttgctgcaagagcaacctctttcacctgaaacataaccaaaactgtgctgatcagatctccatctaaaaacaacatttagtcaaacgtagtgccaaaccccacttatcatcatcagactagtcaaattttgttgatttctagtttgttaagtagtataaaactaggtaaaatttcattttccccaaagaggacaagaaagcacaatattagaaaaattacaagatcagtgagctctcggagtgtggcatccttccacgtgtatatctgcacttcatctttcggctcctttcctctcacggcaaactcttcattttggtgatggccaccaacctgaaaataaatgaccagtaccacaatcagctttctgtgtcgctgagtgtttactcaagaatctgaagtctgtcctaaatgaatggcttgggatttaattttcaacaacactaccatgagttacttgatcgagttatactgcatagaagtgtgactcaactacaagtgcgatatgaacattacaattccatcaaggcaccagaacctatgattcggtaagattgcacaatgcaaataactagcgcaataaagtttctgactatttatttaacttgtattcaaatgaacatatgctctcctcagtcaaccacactaaacagaagtgtaaatcacataatgtgaacttatcatacatacaggaatacaaatgaacgaagttagcagtaagagagataacaagaggttttacctttgtgaaaacccggagcaggagagggcacgtctgcaaaagaacccgatagtgaacagtaagtaaacaaatcaatcaacatggttaacctagcagaatcgaactggaacacaatgccgtcgaatcgcaaggtagtacgcaatctactgctgttccagcgcatcgattgggaggggggcacggaggaggcctcaccttctcgcgatcgacgggttcgacgcgcgcgcgagccatgggaggaggcccccggtactgcatcggcggccctggccgcacaggcctcatcggcatctcgccccttcccgccatcgcaacgagacctccccctgccctgcccgaggaagaagaaagctagtacgaatcaatctactgctccggaatcaccaatcagcaagcgactgaccttgctcacctgctccgccgccgccgccgccgatcacttcagaaggggatgcgagagaagcaaagaaaaccctagtaaactttttgtagattgcaccctgggttcaaatgaaaatacaattttacaattcagtccacctctaaaaaagggacatttaactccatgccacttttaagatgtagcaattaattattagttattcattgtctatgatacgtgggtctaatggcaaataatttagcaccactagtaagagagtaagggcccgtttagttctcaaaaagtttttcccaaaaacatcacatcgaatctttgcacacatgcatggagtattaaatataaataaaaagaaaaactaattgcacagttatgggagaaatagggagacgaatcttttgagcctaattagtccgtgattagccataagtgctacggtaacccacatgtgctaatgacggcttaattagactcaaaagattcgtctcacggtttcccggcgagttctgaaattagttatttcattcgtgtccgaaaaccccttccgacatccggtcaaacgtccgatgtgacacccaaaaattttcttttccccaactaaacacaccctaacaaaatagttaactattactacctccttccctaaatgtttgatgccattgacttcttttaaacatgtttgaccgtttgtcttattcaaaacttttgtaaaatatgtaaaactatatgtatacataaaaatatatttaacaatgaatgtaggaaaagaattaataattgcttaaatttttttaataaaataaacggtcaaccatgtttaaaaaagtcaacgggttaaacatttagagatggatggagtaccttaaaaaaaagcgttgacttgttgaccacttcgttgaaaaagccaaaaaggaatccgccttcttctccactccacttcactcacgccttcctcgccccgcgtcgcgaaccaccgcgcgccatggtcggcggcgagcccttgcggcggcggcggcatctcgccgacgatggattcttccggttcctcctcccctcgccgaagccggccaccaccaccaccaccacccctcctcccgccgcgctgttcgtcccgccccaccgcctcatcgcgccacccgtgccgctcccccagccaccccgccccgaggagcgcctcttcatcgtgccccccacgcgcccttcctggctcccgcctctctcgatacctccgccggcgacggcgacggccccgccgccgactcgttgccctccgcggcggatgggcaatggtggtggtggttgctttggcggccggagtggggtggtggggtggaggtatggaggtttcgtcgggaatggtggacgtcgtggcttcgagcggcggagggtgggaggaggcttcatcggagcagcgaatgcaggcgaggccaccggcggcgagaggcgggcggtggtgcgtaagagggagaagaaggtgtgggtcgccgtggagaagaagggcgaggactgcggcggcggggatgaggaccaggcggcgatgggcgcgggctatgccggtggagatgagagggacgagcaggtggacgtcgacgacgacgaacaagacgacggcgacggcgatgaccctttcgacgtcgccgccgatcacgacctcctcgccgtcgtcgccgatggcgccggcagcgagaaaccaatggaggtagaggaaaactcgaccgagacttcaccgacgcttcatgctatgaaactcttcaccttgctctccctttcagcagctcggatcgccgccggatcaaccgccgccgccgccgccgcgccagcgagtcggaacgcggcggtggagggtggaacgccgccatgacatcgacgccttcacgcccggattgctctccctctacgaatccctcaatccatcagaggagcacaaggccaagcagaggcagctcatcgaatccctcacgaattctgtgagcaaagagtggcccaacgcccagctgcatctctatggatcgtgtgctaattccttcggaaattcgcatagcgatgtagatgtttgtctccaaattgacactgctgcagaagagaacattgctgagctt

SEQ ID NO: 69640 - DNA, 8555 bp, Oryza sativa
cccgggaaaaaataattcttcataattgatgtatttgaaaaatagcttcttaattgacgcaggttgagactgttcatcttctaatgcctgtcaaattcatgcaggctattaccagtgctcgagttccaattgtgaagattgcagatccaggaagtggcttgtcatgtgatatctgtgtcaacaatctctttgctgttgctaacacaaagcttctcaaggattatgcccagatagatgagaggttgcttcagctggccttcattgtaaagcactgggccaaactaaggggcgttaatgaaacatatcgtggaaccctttcgagctatgcgtgagttaaacgactttgcgttcatgattttcccctttttacagctatatgttatttgttgaaaatcttgaacctgatcttgttcttattaatttgcagatatgtgcttatgtgcattagcttcttgcagcaaagagagcccaagattctaccatgtttgcaggttctataccttactttttatctcaccaatatgtttcattcatatgaactactcgctgaagtactgatactttggatgcacacagtttaggataaaatcacttcacgcttgcttcatctgcatttagactcatgatgctgatacaggttaaacgaatggtctgcacacatttttattttcattttcatttttttatctctaaaatacttaacttctatctcttttatttgctggtggaatcgtcctgatttcgcattctcccttcatatatgcatgattctgttttggatggctcgacattcaactatggttggtcaattttctttcctttcttttcttttttttttcactaatgtagcaggtccattttttattctctttgattgatgttactaagagttgcttgcgtctagaattgttcagatgaaatcaggatctgcaaagttgtatatttcagcttcatctatgaattacttccgtcagttttatcctgatgcaatttgtcctctcaactcactccaattgtaggcgatggagccaacatatactgtggttgtcgatggcactgaatgtgcatacttcgaccaagttgaccagcttaaagattttggtgctgaaaacaaggagagcatcgccgagttactgtgggcattcttccactactgggcattccatcacgattacaggaacgatgtcatctccgtccgcatggggaacacaatcaggtgagaattgccaacgagcgtttctcaaaaaccgactaaacttcaaaaattcgattttgaactaatgtcacatatgcttcaaagaatttcgcgtcctttttaacttggttcgatctctggtcgatcgatagcaagcaggagaagaactggacgactcgcgttggaaacgatcgccatctgatatgcatcgaggatcctttcgagaccagccatgacctcggtcgtgttgtcgacaggcagacaatcagggttctcagggaggagtttgagcgagctgccaccattctgcagtacgacgatgacccttgtgtggctctttttgagccctatgattatgaatcttgattattattattagcacataaattaataactagcctggaaaatccagaaaacagtagctatcctaattctaggtagtagtgaagatccagtagcatgcttaaaacacttggtgaacagaagaacaacagcaggttgcattcaagtatgtcaaatttgatagaaagttggatcttaaaatcaaaagtactatgccaacccaaatttttcggaatgcttcccaagacctgtgaggcgtttcacacattctaagaaagttggatcttagaattcctttgtttttacttacagggcaatcctgaagaccacaaagacaaaatagggctttacttttgaagtggtgcatgcataactgaagagtaaaacaatcttatgctacaaaaaccaaaacaatataaaattcatcaccacgcatttagatggaaaaatgtttgtgtaatatatgaagggggtggctggaaattaactgaggcccggaagaagaggagcgatttgctcccaatgagaggccgggaaacctagaccaggccaggccttttaaagcccacaaggcctctactttctcttccagagtagatgggcctcatttcgacccagcccaagatgaagcagagtctttctcttccctttcttttaagagcaaaagcagtgcatcttatcttaaatctaaaatttgccacaacatgctaagctaaattttacacacgccctagtttttttttttgcggttatttgattggtgccacagttttagctagccacattacttaaatgtaaaatttgatgatttgacactttatttcttgtcactttaatttttaaaattgatactttttaggatgacgtatgggaccatgtaagtcaatgaaaatgaatgttaagtaatcgaaagccagctgagtgaaatatcaaattatcacatctcttagaacacatggctccgcatgtcaaaaactcgatttcttgtatataagaatgcataaaggtatggccaaggtgagttgcactgaagctgtgaattagtgacccgaagaaacaacagctgcattatgtggcgtgcacctcaataatattcattttgtgacgcagagctagtataagatattgacatcttttcgcggagaaagatgtggaaatttttgttcttatctatttttgctttcttctgcgtatgctcaattaactgctctttgacagccttcgtgtttgacagtggaaaacatttccttaccgtagcaataatgttgcttgcaggtataattcctaggacaaaactatatactactacctccgtcccaaaatataacaatttttagctatgaatctggacacacagttgtctatatttatagttaaaaatgcttatattttgggacggagggagtatatcatgacaggagaacgaattctaccctacaacttactgatttttcctggtctaatcttctgggccatcatgtcttgaattccgttccaaagatcatactatgaactaagtgcagcttctgtatgagagctgaggtgccactgatcagcagagattgcagaatgatctttctgggcttatgcaactcttttcatctttgttgtcacctcaggaaaacctataattcatactacttcttatgtggccttcaccttgacatactcatcatgatggttattgaagttttcgttatatagcatgcccgttggagaaagaagccgttgtaaagcacttccaaaccgaccctggaaaatggaaacagtattaaaatgtggccaggaaacatttggagtagcgagacattattatatagtgagaagtaagataatgcaaaaaataaggctcgaaacgatagtctgttatctttggtagggaactaaggatacaaatatgagaaaaagaacttgatatattgaaatggtcagatggccttacccactgaaacaagacaagtatccaccagcatccaggcaaactaccaaatttgttgcgaatgatctgttaagaagaaacgagatcagagaagtcgatcattaggatgtgactattgttatttgaacaacaaagaagattaaaggattttcaaaatacggacttaagttcttttagttgctagacagccatcacagagctttatgaactgagtgacagcattcaaaagtaggaagaagatacaatgttcacagtaccaatgcttttttttttctcaagctcattcaacataattgaagtagggacaaaaactccatctagcatcgatctaaagaacctatatctaacatcagtacctcaccaaaggagaaagaaaggaaacagtcatacggtcataccattagtagaaaggttccaatgccaaagcatgctcccattgattgactcaaaaacctgagatctcttccagcctgagaatagggagaaagtaccaagggatgtcatcacatttttccagcacgtgccatattcgactttgcattaatgtgctatttatctactccaataaaacgtaaaatatgatccccacttcccagtgttaaactgctagaaacctagtgccttgagccatgcttactagggaagtaatggcacttggaacaagtaaattcattttgacaaggttttcccagactccaaatgtactttccaggataattgctttaaaagtcagccaaaacaaatatatcagcttaccaataatgttccttcaagactatgcactgaaggtgtcaccaataatgcacagaaatatggaatcagcactttatgcatctgtcaacagggtaatggactgtcagtaagttctagacaaaatcgaaagcatttgagactgggggtcgtgaaaataaagcataaaactttctgcagatagactgagttaagccaaggccacgtcataggagacatgcgcaataatatgcaagtaaatttattttacaataatatgcaagtaaaattctatttctctatagagcacaggaaactaaatgtatataaattgaaggtaaagtaattatctaagatcataaggaccaccctaactggacctatgagtcagaatcaaccttttataatcatcatccgattcagtgaacagattctgcaagcatttacaaatccatagtgtacacaaatgatacaaccaaagtatcatatagagcagatgatgccaaattagatgactaacatcagatcagatataggagcactgaattttcttttcttaacagtgcaactgagttagattctaaaaggataaacggtactattgatagataagaaatggtagtattgatagtttctggcatagtgagaagcaatcagaatcgaatgcacttccagaacagtatgcagaatattttataagttatagagcaaacctgttggacaaccataaaatcattagtaaagagactaggaaaaagccacggaacaagtgttcctactgcccccacagtcgttccagttattgctccaatcatgacaagtgatttcaatagcatccttgcctggataaaacggtacctttagactttagtgtctttgtagtaatgaacttaaaaatataaatgcactttaatgtagaaaagaattccagtagaagatatgcactatgttagtcaatcaaagcaccatcagtgccgcacaggatgcatcaagtatgtgtaatgatgctgagcgtacaagcacaagcagaagcaactgttactctagtacaggaaaagaaggtatgtgtatggcaagcaaatgtatagaaacccttgatggcaaatgcacaactccgattcaaatatttattttagttcaatggtagttgtaaaccgtaaagatgcctcatgtcctaagaggcagcaaataagtgatgggatcaagcttttgttaatttcaacgaacaggattaatacaagagtctcagttgacctcttgcttttaccttcagccttttaactgtgtatcaaagctataatttttgtccagttaaattcgacctgccttgaccgccaataaagttgatatttatttgtggatagttttgcagcagatgtaattcaagattctaaatgatttaataagcttagtttgtgatatcagcattttatttagaagaaatgtgagaaggagcatgtactgaaaattacactgttgaaggaaactttgcatatcagttcggtttatcctaagttcttgaccagagaaaagcgtaaaaacatataaagtgtgcaagcatacatcatcaagctttacacatgattcctttggattaatatatcactaaggacaataataatgcagtacagaaattcacgtgaaattgagagctttagataggtaccttcatcaaattgcacttagctccatatatcaactctggcatgaatgactgtgcagtttgtgacaggggctcaccccaaacagtgcacatgcataggacattaaccataaccttcacagcatagattattttgtatgttatccacagaagaaagtacatagtagcactgtgttttcatcatgggtaagcataccaaaagttaaaaggtatgaacctggtgggctgcaagtgttattgctcccatagaagttgcagaatacgtaagtaacgcgtaaaatgctacctgaatggtttcaaataattaggtatagtaaagttgaggagaggacatggaatattagaacaaaaaaaaaagcataccttggaggtcattgttatgaaaacaggagctgcaatttcaaaaatctgcagaagctcacttgatgatgggattgtgaatgaaaaagctcgaaatcctctcttatttagattttgcatcatcataaaagctgcaacaatctgagtgtgtgtcaaaaaatagctatttatgaaaataatatgttgtcagaagactcaattgtgtaaataaattggatttttgtttagcataacaagtagctaaatgtctggcatacaagttgagtagacaaatcataaagaaagatcgacatggataataatatataaaattatgagcatgtggttccatcaaaaacataacattttacaatagataagtgattgctttataacttaactaggtagcatatcttactagaagatcaagaaacatttgtttttgttagtaatgtggtgtttcatccgattcaagtttcaaagaaaaatcaggtagtgtttattaaggctaagcattggtggcaatccacatcttgccaagtctaaagaatcatgctcaagtaaagatgtgcaagaagcaaggtatgatgaggtgattggaaagtatgcctacctgtgaaaccatagttgcccaggcagcgccagcaattccatatccacatacagaacagagaagaaggtccccaacaccattgataacactagcagctgccaatgccttcaagggaccccaagaatctttcatgcctagactgagttatagcaaacatacagtataatatgagaagcctccaatcaaggtagttgtaatgtgaaatcaaatagaagagctcaaagtgtttattgttatcagaaacatcacaaccaaataactatgtagcccatgcgagttggttcaaatggcaatatgaatatttcaatgacgaatagacattaagacaactcaaaacagatgcatctgtaatttggcaaaataaaaggtcaaagaaagaagacatgatagatttgaaggcaaaagaaatataacttctccagaacaaaatagatcccgtgcaacagaagaggagaagaatgagcatggtttttacctagcactttgagcaactaagccaaccagaactgcaggccatgcaaagcctctaatctgaaaatgaatgagtatacatattgatctatgtacttcatataaaacatggaagtcaaaaacttacatcctatagcatagtgcatagaattatcctatagtacagaacaaggtatgcaatatgcctgcagtcagaagcatccatggatttgcataggtttctgaaatcaataggtttgcagtcaggatcatcctcgtgtttgtacttcagtgcaggaaatgtaatcagcgtgcctcatcattcagtatccatacagaggtactagaaaatttcatcatgtttccacttccttgtatatgtatagctatagtatagctctatgaggtttagttcatagatagcatgcaattgaacttttagccatatttgtttatcctcaaaatttattgactatttgactgctttatacagttatattcaagaaagaaacaagcaattcaaaattgccagacaaacatgatttctcttggcgctaccccaagcatggcagatgtccttcaagccattgctagtgagggcgccctttggtgcctagcaggagcttctaagcttcgtgatcttttgtctagggctgtagagctagtgcactaggtttgttttgcttcttgtgggtgtgtggtgttggtgttgtacttctgggtgggtggatgtcagagtttatatctaatgccatccaccttttttcctctatcttgatgaaatgatacgcagatttcctgcgtgttcttaaaaaaaacatgatttctcttgctcattcaactagggcaacaatgaaaacaccctaaacagtgaaattaatgagagaatgctgacatgtacaaacctgtgcatatgtattggcagcagaaatgatatcatagttccccgatccagtaaacactgaaaataaaaatagaggttgcagtaaaattaagaaggtaggtggactcagacatgagacatgtgaaactctagatagcatgataaatacaagggcattcaatctgagaagcaaattaaaaggaaaaaacagaaataaggtgcactgccaaacagggagaaaaacagtgaaggagataatccagtggtgaagaaatccaccaggttttctccatcaatatgcagtcaggttcttcaaagtatgataaacaaggttgacagtcagtttcatcttattagcacagtttagtttcaacttaccagttaacacttgagtcccaaaaa

SEQ ID NO: 69641 - DNA, 5251 bp, Oryza sativa
  unsure (1)..(5251): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatggtaacgaggtgaacacaaccttagtaacaaacatatattgccattaatgaaagctgggtacgaagtggctggtgaagattacctggaagtaggactcccacttctgcctgaggacggcatgctccctcttcactttctggaaggatctcgtgcaactgcataacaatagtagtagagatctatcatcatacgaaataagccaatgaattgaacaaaaaaagatagacggcaagggctaattccagttcactagcaggaggaactttcacccatcagaatatgcatgtgtaactaggtactaacactcataacagtgagggctgacaggtgacacttctacatgcctcgactgagccatgccaagtttgacaaggtggcagactggcacttagccatttactttgttggtttttccgtaatgatcaggccgattggatgctctggttgccacagccactgcagctgcggcagttgaaaccagctgcagccggcagccatttacaactgccacagccgctgtggctgcaagcctgcaagcacagacgagcacacccagtaacagccatgggcatgggaaaatcacaatgctcaagccatgaacttttaccatgccataccacatgtcataaaagtggagagagagagagagagatacccttcggcgttttcttctccacagaaattcctgaatgaagtgcattcattcttcaccctggaggcaccaatgctgtgacaaaccatatcatgtcaagcattgataaagtacacaaaagattatcacatatgtataactaagcaaattgccagcttcttttatcatgtcaaataatgaaataaggagtgagcatgtactcatgatctaccagctgtgcacctgcaaggctgcaccaatcaaagcaatatgggtctctgtaaatatctctgtttaacatattccctgaccgttcactagaatttcacaagatattaagcaggccattatttgaaggtcttttctttgttgtgtgtgcgtgtggtgggagttcaggtacatcaggcttctggaagttctccttcagcttgtgttcgaaactgtcatatttgcttccattgagaaaaggataaacttaatataaaaacctgagaactatgccagttaggaaagttaagctactttcttgaagactgaagggagaaaaactaaggccatatagtttttatagggtaatgttagttagctttttatagattcttgacactctaaattagatttagtgataaaattattatcacatacatagtctttttgaaagatacaattgtgtgcagttaaaaacttaagatttcaaattaagtttacctacagcatatgctcaaaatatagaaaatctaatcatgttcattttcacccaacaaaccgaccttgcgatgtgtggctctccttctccaagcaatgtttttctaaacaaagttaggtggtttgttggaaaaaggcaggattattttttcctagacaaatgggtaattgcactaggcatacactttcctaaaaaggcaataaaattcaaacaccctgtaaaagtccatcagtgccagttccgtcaaatgacaacatggagatctcacaagaaactgagctgaggcttacctagaacagctgcctttcaattgctgcatgtgtgtgtcccatctggcgaagtctttcggatgcttctcactgtgtgatgttagatattagtaaccaacaataatgctgctgaatgtgaaaagataatcaagacaggtctagtttatgaaattgtcaccacttacatagcttgctcaaaattcaacattaccctggttgaatccttaaaaaacaaggaaacaacctcctctgcaaaatttggatttgcttcatcctgcaaatcctcaacctgacaaaattgctcatccaagtaaccctgtcaatacaaaacgatttgttaaaccagcacacttaacacatgttaaactaagataaagaccagaaaagagagttccgaaatggtgaaaggcgttgattttaaagcatttctttgctaactggggtggggataagtacgaaatggaatgaactctacagaaatatcgataacccacttatattaatataatgtgcttcaatctgattctccttagctttgttttcattatctgtgtgcaatagtgtcaatccatggtatggcaattaaaatggcatgactgtaaggtgatgtccatcaaaacactgtattctatgtcttgctgaatgataaatagcagaagaagatatagcaaaaggactgatggatatatttgcagagtctcagatatgcctcaactataatgcttgaaatttgagatgaacagagcacaagcctgatcgaagaggctctttttcaaggaagctgcttgacgtcgcaaattaccgtactccattcacaagtattgaacagtcaggaaaaaaatgaggcgaagtgaagcctttaaagtaggagtcaatcccaaaaatgaatacacaggttgccgatcacctaagttacagaaagtagaacatgaggttcatttatatagcccaggagcctgttactattccttcaccaacataagtgaagatattttaaagttcgtatacaagtgagttatcccagggtgtgcaatatctatccacattttagacagtgacttgaatagctgcagattctggagatactttataggatactattttgtatatttggtgttcagaaatcaaaattgctcatctataactaagtgatcatttatagaggctacagtacaaaaatattgtcagtatttcagttgacataggacccagtattataaaatccgcccattaaattttatagctaaattctactaaaaattataaaactaacaaaaggatttgtgatgaaaaatacattcacaccattttctaatggtcaactagatttttaacaaattatattgcaaattactaaagtatctttcccacatcaaccccaaccttaataatctcggttatttaataaagatccaagatgaaagtatctaacctttgtagttgcttttagttcactcagtttctcattcaatgaaaagacaaaattagtgcctctcggtatcacataattatgtagaagcatgcaagcgacaacttctgatatgtcgtaagaactctttcaagacttgatgcatcaaacttaatatctcacaggcacaaacaaataaccgtccagttgacaatttattttcaaggccataagaattcacacatgcagggcttagaacaagaataatcatttttgggaaaataaaaaaaatgaaaactatgaattacttcatctgatataatgttttagttagtaagtacctcttatattcaaataacatatgttgagtccaaatatatgaatcataataactcctaaaataagaaattttctagggtgacacattgcaggaacaatcaaatagggaaatgatactatcatttttttcacctcaaagttcaagcataatgcggtgataaaatcattgacaccgatgggaggattataataggccgaaaagattcttactttgtacacatcaaaaaaaaagttggagaaagaaagcgatttcaatagctcctttgaagttacaaacaaaattctctcaaatcagtgggccacgtggcaaactagtagcctttgcccttgcagaaaaaacaaagagtatcatttaccaaaaggtgtaaaataagttcattcaatgattggtcgaaagagtacattcaatcacatcttgataagagaatctgacgtgggttcaaacacaaggaaagtttcaaacatatcacaaaagcaaattctaatctatgcagatcaaactgccatggcagcgaatgataaatgaatggggaacagaaatagagtacatgaaagctagcagttgctacctcccctggataacgggtaatgtgtttaaataaagggacaatggcatggctcactattcatccttacagtggcatcgctctccctttagctacgggacattctcatgacgacatctttctacagaacatttcaacctcccaccagtgacctttcccccccaccccccaaacgaaaacatttcaacctcgatatgcagcaagcagtaaaacatctcccaggaccagccacacaagcagagagcaataattgtatttcctgtaaagatgttgaagatagtacaaaaactacaaatacattattcacgtattgcaattctaaacaaaaagcaacagtggagtattgagtcaggaattctgctatgaatagtttacatataatgtcacgacagcaccttagcacacagaattatcaatttacttactgttcattgaaacaataatcactgcccaggttttggttggaattttaatgaatgcttatctctgaagctattatcctgaacacaattcctctcagacgttgatttacacctgcaacatacaccatgtttattatagtgggtcaccatggtatgataagattctctaattgatgaaccataaacatggcatatatatcatgttgctaggtattcataatactcttcaacatatataacaacaaaaatcagtaacttcctagatataatattcatagtatcagcacagcacacacttaaaaactctcatttacattgtgttccaaacatgtttgttttattttctttgtatgcacacaagcttgcttttgctactataatttcaattctgaatatgaatagattatgtatgattgatagccagaaaatattccgtgatttgcaacaatgctcgatgttatccattttaacactttgtaatgacctggcatcatcagattaacagtgactgcaaacatcactacggcagaagtacacagatgatgggtgcaacccttagcccttacagccttactcagggggtgtttggga

SEQ ID NO: 69642 - DNA, 8358 bp, Oryza sativa
ccctcagcaatgcatacatatcatgctgctaacgatataaaaaagctgacacaacggaatccataactacatagtagagaataagaataaatacaaggccccgtttagttcccaaattttttttcccaaaaacatcatatcgaatctttaaactcatgcatatagtattaaatatagataaaaacaagaactaattgcacagttagggaggaaatcgtgagacgaatcttttgagcctaattagtctatgattagtcataagtgctacagtaatccacatgtactaatgatggcttaattaggctcaaaagattcgtctcgcagtttccaggcgagttatgaaattagtttttccattcgcgtccgaaaaccccttcctacatccagtcaacattcgatgtgacacccaaaaattttcttttcgcgaactaaacgggtcccaagctgaggatacgctacctccttttcgatgttttgattccttgtctgatgtggtggcagccaatccattctttcctagtggcatccaaattggggacaaaggtgcaatgatgcctgcacaacacaaccacacaagtgagagttttggcaggtaccgatcaatggataagagtctcctagcagccgatttccgttcgattgaagacaaaatcagcgtggacgcggatataatcacatgacatcgtaaactccaaaacaatatctgaacagttcgcttggctaatcactagccaactgcaccagcgcgacagatgcaaaactagttcacgccaaaattggaagtttggttgaaattggaacgatgcgatggaaaagttaaaagtttatgtgtgtaggaaagtttcgatgtgatagaaaagttggaagtttaaagaaaaagtttggaactaaacaaggcctaaacagggtacaggggtggggacttgggtgtgttgtggtggttaccttccgggttccggcgcatctcgacggcggcggcggaagactgcatcacccgcggtgagcactcatcgccgacggatctcactgctttcgcgctccccaactctacactctggtggaatggtagagccaataggccatggaaaaatacgattagggagcttgcgcttccagcggaagagagagcagcgaggagatgcggcgactccggtggggaagaggctcatggcgaggccgcgacggcgaggcggctgtcggcttcgccggacgagcggcgggaccccgggagagggagatcagagagccaaaatacaaaaaaaaaaaaaaagaacggaaacgaacacaacgtggccctctttgcacggtccgatgcggatcggagcaagggcccaagaagagattagtcgaggacgaataaaaaaaagagagagagagagagagataagtcgaggacggagaaattccccaagccgccgccactaaccctagcttccgccagcacggtattaaaacccttccgctctaatttcctcgcaccattgatttttgttctgtgcgttcgtttcgatccaagtagttccccaacaatcctgctactgcggaactgccgattttgctgtcagtttattttgatcgcaaacagtaaatattagccgagcgtcgtttggcattatctttcaattccatgcttctttcaaatttgacccatcatgcatgttatcaaaatttactagagacccagaaatatgccgatgttctgtggtgacatacctatgtcctgttttttctagttagtttgcatgtcttgaaataggcttgtggaaagaacttgtgtttcgagcttcatgttagagagtggtgggatggcaccctctaataggccacttgaggtctctaattcttttgttttcccagtctgagtcagatctgtgtaagaatcttacatttctagtaatagaaattgggggttactcccttgttttaaaaaaaaaaggaaagacccaaaaaaaattcactagactaagggcatgttgggatggtagccattgccaaaattttggcgaagtgggtttgtttgatttgatgtgaatatatttggagctttttttaaaccttgccaaaatattggcattgcaattttccttgtatcaaaccaaataagtgccttgccgttaccaattttttgtgttgttgatttaggcacataagatccaaagtattcatcgtttcctgcagggtgcagatcaagttccaaatcaacctgattggtcctcaactttgagggtaacatgatgcgagacagcaagaggacgaggtccgcaccacccagagaaccactggaaatgacagaggacatgaccccaagaagcaagaggaggaaatttgtaccattcggagaaggtgcggtgctacctgaggagatgctgacggaggtgttcctacgactgcccattaaatccatccttcgtttccgggctgcctgccactccaggtatgcaatgttgtcttcccaggaattttgtcaactctacatcacaagaactgaggcaatgccaccacaacctaagcttctgtttatctcgcctacagcaaatttcaactccactgcggtgtacacgtgctcgccatcgaagcccattgatgacctactgttcacactcgatgatgtgcgtggaaactatgtggaagtggcaccttcaccatgccatggcctcaccctcctgtataatgctgttgcgccagcttactacgtcttcaatgcaactacacgggcaatcacacggttgccaccttaccaagatgtgattcatgccactgctggcgttgggtttgatgcccggacgaaggagttcaaggtggtgaggctttttcgaggaaaatcgcatgagatccattctgtaaagtgtgagatattcattcttgggggtgaggaaggggatcattggaggcctaccgctggtggagtacctttcaggttctgtagttttgctctttctgctatccgcaatgcagtggcgaacaaacttcagccagtttttgttaacggatttctccactggttgatcaacccctcgtttttactcaaagcaccaagagctgctatcatatcattttctctcactgatgaaaccttcagatggatccgatcaccaccctttgaggtatccagagtgcacttggctgagcttgatgatcagttgtgtatggtccgagaccttcgtaatggcttgcctactggtagcatgtttgaaatttggaggctgaatgactataactctggtgattggtcgcttgattaccgaattggtttgacagggaatttgccaagagatttacttgagccacgaattgtgaaagttattggttcctttggtagctacagatcaagcaagaagataatcatcgctacatctaagcacaaggtgtgtgcctatgatccagtttctagaactcttgaaaccattgtctcaatcatggtgacctgcagtgcctatcaaaacgagaaatctgatattagattcagttcatttacaaagagttttaccccagtgcataggacgaggaaagagatagggttctctactcccttgtctaaggctactaaggagatcctactccgattaccagctgaatcaatcttgaaattggaacttgtttgtaagcaatggcgtggattgataaagaatgaaggttttgttcatgcatactttgagcataagaacatggacaggaggccaaagatcatgcttgtgggtaagggctctgaaaaatcagttttcaactttattcccttgagtaaatggctccaagaggcaaatctaggcacaatgtttctggacaaaaaggtggtttgctccaagccttgccatgggttgaatctggtgagcattgagatgaaagactatctgttcaacccgtgtacaggttaccgcatgatctactagaacagagaccatcagctgtaccaggaatggtccaatttgtctagtgatcgctgcaaagactacaatccttttgtagttggcaataagaatgttggtatggggttttgccaggtgactcagagtcatgccgttgtgggaattttctattactggaaaaactacgaatctcatcagtattacttaacatgcattatatggagttgtagctcccaaggccagccactccccgatccacctctgcctgtgaatgacatgccacctgtttctctggatggtgtgctgtactggatgagtgaaccaaggttgggtcagagttatgagcgggccattgtcttttttaacattgccgctaagatttttgatgttatcccttgcccttcatgcattgcaatctgggacagcagaaatccatgtcacgcatttgtggtcgagcttcagggaatgttgtgtgctgtcctttcaaatccagttgcagataagttagatatatggaagtgggatcatggtctgtggagtatagcatatgcaatcaatttaaaattctggccagattattcccttgcgacaaatgttgtagtgcctctcgcagttgacccaatagatggaaaggttctactgaatactgggaggaagcttggtttatataatccatgtgagcaaacaatcgaaaacttgcacttgatcaggcgtcgcagcaacagaaccctggagttaacagaaatttccacattgccagatgccaagatgttcctaagaagttctctcagtggaaactattattggctccgtgcgagaagtttgctaacccttcaagtgcttcatcagggaagaatccattttactccagagaccaatctaaggagctaaatagtgtgagtcaaaaaattatgcctctggttcctatgttgtacgaggagggtttagcttactatcctacaactcctaaattgagagtattgtgcgattgaagtgttgtcatattatgggcctttttcatggctcttgttctgcctctcttatagctggagcgtaactaatatagatggccataaggcccgaggcctgaaggcccggcccatggcacggctttttggcccggcccaaagcacggcacggcctgacttggatcgggcccgtgccggccggcccgaccgccgggctgtgcctgggcctccccatcggcacgctgggctggcccggcacggtcgggccagcctggcacgatgggccggcaagccaggcccggcagacaaaatatagggactaaaaatagacataaatgtcactgtccaaagaatagggaccttaaatagacttattttagttatttacatatcacagcccaaagaagagggacgtaaaatagacttttttagctatatataagtcacagcccaataggaggaaggaaaattatacttattctgaggaaaagcacgatggcccatcgtgccttcgggccggcccgacacggtccgaggcgtgttgggccgtgagtgcggcacgtgggctggcatggcatggcccgatgcatcggtcgggccgtgctggcccgacaagcctcggcccaggcacgaccgggcctgggccgtgccgtgccgggcggcccacatggccatctatagtaactaaacggttccagctctatcaaaaggaagtgaaattagttggagtgctctcataaaatgaattattagataggtggagagttgggtttaggccgctttcgctccaaatccaacttatgaaattaaatttaagagttgaagctcatatatagtagctaagattttataatgttaaaatgccgtggtatgtcccgttaaaattgtagtcaggggtgaagctagcatcaaaacaaggggggtgcactatcattgagaatctacaaaatttcagtacaacactgtatattctaatttttttaagtgagaaattaggaatttaggggttcatgtgcatcccccccccaaacactatatagcttcgccactgattgtagttgtcatttcaagcccagcttttatagctcaaagaccttaacattatttcctactccatcactgcaagaatgtaaaggcggatgtgaaagcaacttcctactcaaatgcaagatatttcctattttcagctttctcactcgtactacgtattttaacgccccttgtttcacttacatttatacttatccgtgagatttattaataaaagaataatttatgtataaaacttctatatatctgtccttagcaattttaaaaagtaaaccatgatgaaaaattcacaaaattaactcgaaagttaagttttaaaatttaaacttcggcttgtaagaataagcgatagaatggtgctgtagattatatactcgtgtaacgatgaggtttcattgcctgagatcgagtgcatcatgtctcgagcagtcaaatattagagtttcctttagcccaagtcataactagatggattcacagttgatgagctgggaacactgggcgaacggggtgagaacggtaacggtaattcccggctgaccggcgtttgtttctgactttctaccggccgagccatatgaaaatggtaatcgaccgaaaaaaatatgaaaatggtaaaatatatggaaatggaaacggaaatggttttattgttttaccgatcgtttccgtatttaccgtattcttgtggaaattaccgtttcttataatatgataattaccgtagttctaaatatgtcgatatttatagggcatgtctctacttgacccatagtttagaggttgaatgactcttcaatcaaattcctaacttgagtgcatggctaaaatggagttaatttatgatttatatagtatagcttgaatttatttgtacatatatcatacttatgtaaagttttctatagtttaatgttttcatatttgttaccggtttccgatttgtaccgacatgtttccgtccgtattattccgttttcggttttccgatatttccaatatcgttttcatttccgactttaccgttttcgatatcatttctgagaaaaaaatgattatggaaatggttgaggtgttttcagatctttcatatcgtttccgaccgttttaatccctacgcgaacctaatactcctcctagtagtcaagaaagtcactgacaaaagctccctacagaaataaagaacttctgtaattaaatttctttctatagaaatatctgaagactttatctaggaattttagatagagatttttactataaatttagaaatcttttttaacgaaactttctatagtgaatcctttcacaggagttaaaaatagagtaaaaacctctaatgaacattttgaagaaatttctattaaagcctctgatgaaaataattctctaccttaagtagaacaaacaaattgcatttttaagtttcaatcagctaaaagtacttcgtctatctcaaaatataagaatttttagtaagtttagaacaatttagggtgtgtttgtgtttggtttgagggatcatgaatgggagacggtgatccaacttttaagcaacaatcaaaaacataccatgccccttattgaacaggcatggcagatggcatcactcttgatcggtttaattgtcggcccatcttgactggtgggctaatctatctataccttaatagttacacgctcgcgcatatatacatatatatacatatatacatatatacatacatatacatatacatatatatatgtatatacatatacatacatatacatatacatatatatatgtatatacatatacatacatatatatatatatacatatacatatatatatatacatatatacatatatatatatacatatatatgtatatatatatattgagggaatggttagttcatatctaataattggatggttacaaccaaatacttctacatagaatgccaaaaaaaaagtacttctacataataaaatttaaacgctagacatcctaaaatattttgaaacatagtgagtaatattaaaaacaaactggtaggaaatcattagctcactgaaacaagccatcgatcaaaacctcgcctcctagtcctacacccatggtctcttgatcgaggtgttcattttttttcctcaatcgcctcctacaaaacacgccggtgttgcacacccgccaatggtgtggaacgctgcttagagcagatacaatagcagactattaactaattataaacatattttaatgaaataaaagataagagagaagagcaatgggctacagatatatagtcagttgcagcacggactctaagacgcaatgtggatatgatgggtgagaccatatattaatagtatagtaagtaactattttatgaattaggtattaggtttggttatagatgaattggaggtagtagtgaactgtactattaaactttctcttatgtattgggctgtgtgggtcaagtac

SEQ ID NO: 69643 - DNA, 2537 bp, Oryza sativa
gtgccacgatatatctgtagctcatggccagatacctggaaaatttttgtttgttagtcttaactatggttttgagagatttcacattgttcatttcctaattcctgattatcagagataccgacagggaaggagtggctagcacttctggacaattcacattcaacacatctctagcctcgttgcacacctatcttggtggtaaatgtcctcgctatccttgctatatgatgtttgatgctgatagaaaagaaagtgtaataagactctttatgtgtcactcagaggttgatgatacacggggtcgagtttctctcttagatggtggcacaatcctcagcttgccaatgctatatcttcaaggtaggtcttgtatgtttgtattttatttcgttaatccgcaatcttgattatcatgccagcgttgaagacacactaattagtgatcacaatttttttttcatgccatcatttctccatattattttgtctgcatgccagcccttctaagttacattcttttcttttgaactcacttgacataacctggtctattaacgtatccactgttattgttaatgttaaaaagagcttgagcaatactactatctatttatatagacttattatttcagaggaattgcacataccatttttagtcactatttcctttatattgcagttatacagccatgtgaatatacggagtactttgtagtgagtttaggacctgaggtttcttttgataattgataatttcttaatgcatatgactagagaagtggcatccaataatctaaaaggctacaagcatccctaaacagtgttgttatgtcgacatttttctgttccagtcctgcgggttcatgatacaattggatattaactccatgggcagtgaaatatattcttaattttaaatctggaacataagaacaggcacaaatccttacctgtctctctcctgactaatgcataacagtgatagtgtaaatgcgacaggatttttctggtaggttatcaagcatcaaatttattataatatgaatttgtttcaggtgttgtcctatttcctggagctaccctgcctctcagactaattcagggtagatttgtagcagctgttgagaaagctttgaggcaggtcgatgctccatgcacaattggtgtggtaggtgccagtctgttgaaattaactaattttatttgttgaattcctttccaatgacgcagtttaattttcaggttctcatgtacaagcgacacagtactcgacattatgctaatgcttcagttggaacaacagccgaggtgttgtacattttctctgctgtgcttcaagttagaatttgtttatcagttagtcattttcaccgattcttcatgtggtttggttgttttctgtgctgccaattgagcttttccgtagccagttccatcatccttgggtgatttgttattatttctacaggacacataagttaccctctcgtcacattttgtaattaagatgatctgcttaataaataaaaacatgagggagttaatttatatcattcaagaatcaggacccagtcttagcagttagcatttaatatttcttgtaaatgggacaattgaatcattcatttagaatagactgatatccaatatttcagaatttccttcacttggtcacaatatctctatcaaacttttggagaatcatgtactcatctagttttctgatacttcacaagatctagaagaccaacagaacatataaagccccatcgtttggcttatctgcggaataagccaaacggcgtatttgcaaacgaaaagtaatttgtgaataaaacttttatatacgtgtccttagtgatctaaaagcaaaggctgaaaaataaacttcgatgagaaaacctcaaaatcggcttcaaatttaaggttgaaaattcaaattttggctgataagcataagcataagtgaaaagatgaggccgatatgcactgtgatgtcttgtttacatgtcaagctcggtcattagccccttagtatgatttatgtataaagtgatgtataattcctttcgaacagcctcacaaggtaagctggtattttgttatttctttaacagataagacaacttgggaggatggatgatggttcattaaatgttgtagcccgtgggcacaaagatttcgtctgaagcgtcattggatggatgttgatggggtggtaagtataaatttaattgaagatatattattctgaattaggagctggagagaagttaggttcattttttctcactcaacaggtgtggggtgatgtccaaatcattgaagaagatactcctttaagaaccccaagggatgcatttgcacagctagcatcatgtaacagtttacggcagcatacctcctcaccagttatcagtttggatgtctctccaatcaaacaacgggatcatgtggattcagaattggattgtggtacaccatcacctaaaagcactgcaagcaatcattcagcgattgattcaaggatgtgc

SEQ ID NO: 69644 - DNA, 19482 bp, Oryza sativa
  unsure (1)..(19482): unsure at all n locations
gattcttagcccaacgattgtaaattcttatgttttatagataccactccactagtgtttcccatcaaaaaagaacttcttattggatgattgatcgttttgagtgttattgagcatctcgctctgtatgtttattttaaccaaaatacactattgtcatttgctgcagacctctggagacagataatcacacacccaagcatggatgattacgtgagaaaaccagatcttctgtcattttccattggaagcaaacttcctgtatcagaatctgtgagacaaaagctactggagattgatggaatctcgtatcgtcttcgaagggagattcagcttctcaaggcctttaatctcataaaatgtagatgctgcaaggtaactatctaccatgtttggaattgctaatttatcgagcttctgattggaagtaatggacttattgttggccatttcgttactactttaaaagaaggtgaattgtttatggtggtgttgtatgttaatcatatgagtctgtcacccgacagctcaccattgcaattttttggacaaccccttaatttttcttgaattgcacagtagttaaatatctaactgaatacacatacacagacacacagtatatgagttggtctataatcaaggagtttaagcactgtcaagttctccctgtagcgaagttataattctgttaattggtatcaaccacaagtatttagctagttttccatataaaatggataactattctaggtcatctgtatcgtagcaatttcatttaccatgtcatggcctgctaaattatctgtatgtacatcccattttcatttttcagcagggtatgacatggtacagtttgtcgttgtagaatgctgcagctgcagcattggaagaattagcactaacataaaatcaaactacttgatagttcatattgatttgctgattaggctcatttggctgctaggaaaacaatgctccatgtaacctggttttcgttgatcataaacattatttggaaatggcgtgtagttacatcaaagaatttcaatacaaagtttatcactctgtgttgacatgatttgaactatggcagtctctcatagcaaagcgtagcgacatggtagtgatgtctactgatggtcctcttggtgcgtatgtcaatcctcacggttttgtccatgaaacaatcacagttagcagggcaactgggcttgctcttgatggcaatccttcaacggttcacagctggtttccagggtaaatctacagtttctccttgttctttgtaatcttcatgtccatcatacaccctttaactgtaaaaaactaagttcatgcatgattttcttcttgtaaccaactttgtttctgctgctatgcagatactcgtggacgattgcatcatgtacggactgtgagtccaacataggctggttgttcaaagcaaccaagaagaatctgcgaccgagatccttctgggggatccgtagctcccaaattgcagatgatgcacaagaactagatcaggacgaatgatgctccgtgtacagtagtaaactttgtgtgcccctccctttttcttatgaagttatggaaaacactttattctctggtccataggcctagttctccgtacctgagtagtggtcgttgtgacgatcgctatagaataaccacttcctcctgtgtgtattacacaaccattgccttatgctaaagttccgtcacagaattttctgaaatgtagtgttactagaaatccatagtacaagatgaatgatgatatgatcagatgtttcaagcaatggtttgacatgtcttatgagcacatagaagttggtgcttgataccttcacttgaggcaaatactcgtgctgtagtggtaattggtaaactggtactggtagtgagctagcactggcagtgccatgtttttgctatctgtactgaaattggggccaattgcacctgacgagcagcaactcaatatgggcatatggcatcctttttttccctgcgtattgtccttttgtttcagccacagtagcaattggccggtattccattgccacctttgatgagagggagggagagagagacctcacgggtggcagcaaaggcaaaggagcagcaagaagccgacagagaaagtaaggccatggtagaatgacaggtgaggaatcgatcagacgggaggaaaacaacaccgaaaaggaatgcacttctctgcttttgtatatgcatgcacctctacctacccattcgcgatgcaccaatgaaatacgttgccaaataccttaaaatactagtctattgttcaggtgatagtaatattgacactagtagttctctaatctctagttgctagtcttgtttatgttctattttttcttgttgcaatagtagcacatgatcgtagtaatgctgtatgattgatgattggatggcatggaactatgaacggatcaaacttatctcgataatatggtaataacaaggagatgtagacatgtactccagcattgtagtcagacagccgaatcacgaagctagtgtggaaccatgacagaagaaggcactactcagaataaatccagtcacgggtttaaaaaaaaaacagagagagaggagaatcatcatcacaaagctaatgcaacaacagcacaagcgtacttccgcatgagaccaagcaaggaaaaaagaaattccaaactgtccccaagaaaattcctgccccaggagagcacagcgccggcctgtacaggtcatcgttcccaataagacagggggaagctgagaggcaaagagcaccaccaacaacgcgtgcactgaattgcattgcacatgggacatggcaaacaccggcgcgtcgccacccgcgcatgcacgcacgggcgcgggcgcggccacgggcacatcctctcctgcgactcgtgagccgtgtcattccatcgcggcttcctgctcgatccgctccctgccatgcccgtgaccgtgatctccataaattcccccaccctgtgcgcgatgcgtctatcccccacgataattagtaggcctgccacctcttgccgcgagcaagacgaccacaccaccaaccaccatccatggcggtgtccgtgtcgtggtcgtgggcgccgcggttcttggcctgcgtcgcggtggcggtgttgcttgttacgtcgggtttgggcggtgcggccgccggcggcggcgggcgacgccatgggcacacgaaggggttgcggccggggaaggcggcggcgaagccgtactatccggtgaacgcgacggcggtggaggcgatcgagcggcagttcacgcggtgggtgcggtccatggtcgggcgacgccacagcacgttccagcgcgcgctctaccgcgggctgctgcccacgcgcaccctcgtcgtcgacaagaaccccgccgccggcaacttcacgtccatccaggccgccgtcgactcgatcccgctcatcaacctcgcccgcgtcgtcatcaaggtcaatgccggcacatacacgtacgtcactcacgtggctacttaatttggtctctgtaattttcttccacacccccaccgtatccagagcgttcgtccgaatgcctacaccgatctccccgtgcaccgtgcagtgagaaggtgaccatctcgccgctccgcgcgttcgtgaccatcgagggcgccggcgcggacaagacggtggtgcagtggggcgacacggccgacacggtcggcccgctcgggcgccccttcggcaccttcgcctccgccacgttcgccgtcaacgcgcagttcttcgtcgccaagaacatcaccttcaaggtgagcaccactactacactacaaatgcggcatcatttgtgccgtggcgtggctcattcgtttcgtctgtcgcgtgggcagaacacggcgccggtgccgaggccgggggcgctggggaagcagggtgtggcgctgcggatatcggcggacaacgcggcgttcttggggtgcaacttcctcggcgcgcaggacacgctgtacgaccacctcggccgccattactacagagactgctacatcgagggctccgtcgacttcatattcggcaacgccctctctctctacgaggtacacacattgcttctttctcttggttgcatacacatttcctccatgaacattatagcagggaattgcatgcaacccgggtgattaggttgaaggtttgttgctaaccaagatagataatttaattagcgcctgaaatcgagtcaaacaggaaatctatgctcaatcctgtgtgtcagtgtccagtgctacagcccaaatgcacaacagatacaccgtgtcagtaaacactggcccgcagctttctgacagggcactggcctactgtggcacctactacaatgcaccacactggagtcacacagaagaaagaattctactatcgaccactgttaaaactcacagggttacagtagaggcaaaccactattatcggccacattagccccccgatcttgtgactggccctactacagctacacgaaccagatggtgccaatgcgttgtgcatgcccgtgtggcacttcgtttaatgcgaaatccaacgcaaatggaatgttgatgagcccactagtaatagcatagtgagtaatcagcctttcggtttttaagaggagtgtggtaaaacctgcatcgcttgtcgttggcgccggcacggttgccggatggggttttctggagcccggcaggttctctggtccccctggccccaggcgccgtgaccgctacggcccgtgacgcccatagctggacgtctcgtgccgtgcgtatggccccaaaccgtagcgtatgtgtatagccaccagtctcctctgcaaatcctgctcactttggtcgtacactttaaaatctggtactagtccaacactactaccagtagtaaccgacttttttttttggtcagaaatcaaaaattgacctttgggacgatagggtcgtccaagctccaagggaaacatattatctgctgtaccgtgctctaactttaagtgattgatatgtgtactatcccacatctaatatgtccacatgtcaatgacccattcacccatatcaaaggatagttctgtagagaatactcatccgtcgtgcaagtgcgcaacgcacctagcatggttcgaatgctagactttgtaatagtattcaccgtatttcagacattcagtaatactccacacaccacactagtggttattctaacgtgtgttacagtgtgtgatcgtaaagaatactagggtttacgcaaatatttgatcagaaatcctttgccgtgtattactttggtcatgtatgtactcagtactcacgttggtgacacgattgcagggatgtcacgtgcacgcgatcgcgcggaactacggagccctgacggctcagaaccggatgagcatcctggaggacacgggtttctcgttcgtcaactgccgcgtgacgggctccggcgccctctacctcggccgcgcctggggcaccttctcccgcgtcgtcttcgcctacacctacatggacaacatcatcatcccccgcggctggtacaactggggcgatcccacccgcgagatgtaagtagctaccactagtacagaatcgaacatcgtgaacgatcatatcactactattataatgatatgtgggtctcatcctatcataccccacccatcaatatttgtgatgatagcgtcataatggtagaggatgtgaaccccattcacccctcacatccatctcgttcttgtgttttttcgctaacgatgctggtgttttgtgtgtggttggtggcggtggcaggacggtgttctacgggcagtacaagtgcacggggccgggttcgaactacgccgggagggtggcgtggtcgagggagctcacggaccaggaggccaagccgttcatctccctcagcttcatcgacgggttggagtgggtcaagttgtagcaccacgtaggagagaaacacagctcactcgactattagttaacttgtgaagagaaaagaatagaacagaagaagtggcagataaacactctgatttgattcgattgcagatttcaactttgcagttgcattgtgagacagtcctatactgtgtccggccttcgcctcggttttgttttggactgcaaacagtataacatcaacttaggcccactggcccaggcagtagagaggtagcaatcgatgcgatctccctgctcagcctagaagcccatagagaattgaagtggggaaataggcccagaaaaaggttagagtagtgtagcagaagtgagcccaacaatcacaggtgtgttgcttccatgttccaacacgtatagccttttcgaacattattccttttttttcaaacattattctagacagacattttaatggatttctgcaaacttttagtagtagtagtattatagacccagtggccaatctctaataccgatttcatggttctaaccctggctagagattgggccacgtggcgccctgaaaatcaagtttgcctccctgcgaatttgccacgtgtctccttggctctcctcccgcattgtttgatcgagtatcgacggctaaaggctacagctcgctgtggtggtctggtggacctcgttagaaaactggaattttttttccatgaaagtgctccatccctaatccacccatcttcctcccggacgcacgcaccgccgtccccccgccgcccaccggattctccaccacctgcgcgccgcggccagcgccgcagtagaccacccgctcgtgtcctccttcaagacgctaggctcgtcttcttcaacgccgcccggccaccttgccctcccctgcgttccctgccgcaatgccgctgcctttcctcgaagccagggccgccgtcaattcgccggcaagagtcaccctctaacaggcggtggccatcgccgatacaaacttcggctagatccggtgagcccacgagagaaagaagggagggggcgctagctagcagaggaggagaggaggcggcgtgcgctggtgagaggtggcatcgcatcagatccttcgccacctgcgcgtcgcggccaatgacgccgtgatgaaccacccgctcgtgtcttccctcaaggtgctgcgccgactcgtcttctcccccgccgtcgtgcccgcgccgaggttgagggaacgtacgcaagcggctgctgtgcaggctcgatgtggagcgcggcgcgagggctgcggccaagcggcggcagcgatgtcggcgatggtcgtgcgggcctaatgtggtggcagggcagggcggacgaggaccgacgatctgggatcaacacggcggcagcggtggctggggcactaggcactggccacggccatgtgaacccaatgtggcagcaactgccgcgccgccgaaggccatgtaaatttgtgctccgcaaaggctccatgaggtgtaggctccacatatgtgaaaacgacggcggctggctctgctgcaaggtttgtgcaattcattctacaattcattctacaatgcatatcttgcagctaggaatcatgatatttcttttaaataattaccattatgtctctcaaaaaaaagtatgcagtatttattgccaataaccttgatttgaaaagggtgaaaatagtttttgttacatatagttatgagttacatatttaaacgcactttattaagtgaaaaaggattgctctgcactggacgcgtttcagattagaagttcagatttgcaagatgcggtttatgggctttcattccattctgttcaaggaacttattttcatggttgctgtcggtctgaatccataaaactcttctatgagatgtagcttactttttttttttgagtcatgtcattgtatcatgcttgctctattaaaatttccatcctcattagctaatagaaagcagatcgtccgatttgaatctgatttccatcgtcaagaaaagcggtgattcacaacctatactcatctactagctagcttaacttatcagaaaattggaaaggacctttatcaaaagctgtgatcatttcctcaacaatgtatgtctatatcttagataatctatattcatgtctttgataatctacaataaatctaactactaaacttaagtaaaacaaagttatggctacctattatctatacatatatatattccaatgcttgtgatatacatactattacaatttcatcctcgatctttaaattctaacttgattaggcactatgtcatactttggcagagttgtaatatcactgaactgaaactttcatatgacaaaaatggccattaatttgtatagatcagctgctgctgcagttacagtgcatctatatgtcatggtgctgtttggctggtgctttaatcagtttgttacatgctgaataaaatgtcatgatctttgtacatgctgtcaaagttgcaaattttagctacatgctgccaaaaaatttcatgatctgtgactctgtgtatgtgctgccatgatgaaattcctaagctgctggatttccaatttctttgttcccctactcaatttagaagaagtaagagttgtggtcaaagtgaaggagcgttctcagaataaatgtgctctactcttttttttttaatcaattagtttctctggttttgttttattcaattccaatattatggcatggcattgatagctcaggaacaacatcaatattcgactgaaactaactacaatatacttgctaaagtgcatatctgcagctaaaacaagcaaaaaagttttggatcttaacgaacaatcatgtaaatagcttatataactgctaaattttattcacataatgctaactaaatttaagttccaaatgccttgctatgttttctttttctttctttcttttttctattgcagattagtgtagcggcttcctgaccaaaggtgtaaagcatcactgctatcaaagtcatttgactgatatctgattgacgtcctcaacggttgacacatactcatcggtcaagtcctcaacgtacatggagttgaataagtttgttgcaatccattagcaaacaccaaatgcagagttagttttttggtggtacaagatggttatgcacatgagcaagagaggcagagagcaagtgaaggggcgcaagcaacgatgtatcacacaactcacactcactggtgctttgtccagcaccaaacctcagcaccagatttttgtgccaataatcacatcagcttgggagatgtcttcctgatgcggtgggcaaaggtatcgagggccatggaaccggttgatagcccgaggagcaagagggatttacaggaggtggaggacagggaacgcatcgcagacttgttctgtacatgtttattagatcattgtgacagagtgacatgttgcactatcaagtaccaatagttggttgggattggaatgatcaaaatgagttgttcatgttttagaaggctgtgtgtttctccattttagtttagatttgagaaggttctaggtttttcctttaaccttttcactctgtttctcgcccaacataactcagtttttctccttttcactctgtttaatttatcaatttctaaatagtgccacacggtccaatctccggtaaaactgtcagcttgagaaaagtgatgtggaggaaccatgaactcaatgtcttgctgcattgaactaatatgaataaaagggtaaagtttaaataatttcaggttttaaatagatactccctccgtttcacaatgtaagactttctagcattgtccacatacatatagatgttaatgaatctaaacacatacatatgtccagattcattaacatctaaatgaatgtaggtaatgctagaaagtcttactccctccgtttcacagtgtaagtcattctagcatttcttacattcatattgatattaatgaatatatatatctagattcattaacataaatatgaatatgaaaaatgctagaatgacttacattgtgaaacggaggaagtacgttgtgaaatggaggaagtaaaacatattaggtgtacttatcagagcatttcattcatttatttcataaaagctggtcaattacgcggcacggcattttctagtcatatagtataccactaggattagaagtactgcactgtagtacttactacgagttgtagtaggtattcgactcctactgtcctacattgaactgagccactgacaacatcaagattaggcagcgtatttttcaggggctgattgatgaaaactaacggatgattttctttatcatggatttgaattaaacagtagtattttatattataagtcttaactgatatagtttaaaacaggttatctaaataacgtaataagaaagttttttaaaagaaaatgtctttttttttgcggggaaaagaaaatgtctttttagaagcgtgaaatacataatctgtgctgataacgggccttgacctgttacggagagccaccgaggcgacaaaaacaatcttctacagtaccgtagaccgtatgcttctgcatcataactactcctacacagaatcagagttcggaccaatactaaactgtcaaaactcagatctactgttgatctagatccaccagcagtagcagcagcagataaaaacaaatctcaagtcccatccgttccgactcacaccgtcagcaaaaacaagattgacagctgcaggtcgtgtcctcttcaatggagtccaaatcgatgtgtgcattgtcgcactgtcctagctccgcggtcgagaatagctgatggaaataaattccgcgcagcgatcctccaaatgctgcaaacgagtgacatattgtatcgagttcgaaaaagtttgaacagaattcagtggttagctgctgacatgtgcttggttaatgaaaacaatatggtcactgcacatttcagacggtccaagatgctactagtaacggttaagcaattccctcatgcatctcgggagacacgcacaagtccctttgtactttcaggtgtgccttttatcctaagagacaggattatctacatctaaatctggttctagagtcactaccagaaatgacagacaacatcaacagccaaacaggaaaaacgctgtgcacatgacttgcacatcactttagtgctcgttggaacagtgttcttattaatgtatagtactgtatagtattcatccccgtcttaggtaagctgttgtatcaggatattgttaaatggtcagtagcgctcattaactctgaagaaattctgaagactgaaaaggacgggatcatctctagaggtggccaaacgggcagcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcaggccggcacggcacggcccgcggcacggcacggcccgtttcgccggcggcccgtcaggcgcggacagggcgggcggcggtcgaatgggaaggcgccacgtggcactaacggctacttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtacctgttcatacggctgtcgttgaggaggtaccggttcaggcggcgacagcttcggaaggattttccggaaccgcgagcggaagtgtttcgacacacaccggctcgaagagatcgagaacctccgttgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtggagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgaatgaaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctacattatttaaagaatacgaaaatgatgacgttctaactgaacctgtctttcacatgaaacaaaaatatttgaaatattggaaaaatatacctatgttgtatgcttttgcttttgttttagatcctaggtgtaaattaaggggattgtctgctattttatcacttgttggagatactataggtgtagattatagttctttttatactgaggttagacgtaaattatatgaggtttttagaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttctttttttttaacattagcaaatcattacttttttaaaaaacttttatttccattttttaaataccattttttcattttttaacattagtaaatcattacttttttttaaacattttatttctatttttattttttttccttatacatttcctttgcttttttttaaaaaaaaacactgtgcactgcaggctggcggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctataatcatctcggcgtccaaatacgctcaggcaatgaatttggccactctttttccgagccaaaccagctctggacgtgttatcagacaaccaccgtttgcaaccatgtagggagggtactattttagcgtccttttgcctgatgcttcacatcaaatgcacgtcaacatttaagccatccataaagcaatgcagttgtggtacactgcaacaaacaaccacaattttgtcttcagtgcaaaggatctgccagtgccaagaaggcaggaactcgtccgtgtactctttacttcttccttcccttaacttccatgccatttcagctatcaacctatacaggtcggtatcagataccgcatcagcatttaagggggagggatttaggactgtttagattgtagccaaaataaaccttattaaattttgttattgccaaaattttagcaggatttcttatatatttactaaagtttggcagtaaattaaatgtagtcactttttgacaactttaccaaaatttgataaggttgaaaatggcatcaaggtgaacaggcctttgtttttttgtgaggtttagtccctctcaccaaaccaccccgtaaggcctgagtttagttaccaattttttcttcaagcttccaacttttccatcacatcaaaactttcctacacacacaaacttccaacttttccatcacatcgttccaatttcaattaaacttccaattttgacgtgaattaaacacaccataagccacactgtcagaaaaacaaaggaatggcatttcggaactgtatgtacttttgtttcttcctcctctttttcccttcctttggcagggattcacccgtccaatttctcataggtaagtgcagtaatttagaccgttttggtaattgagaaacccaaattaaatttacaattttataccatgaagacaaactttactctatgacacttaaaagtttatataattaactagtggacattgtaaaaacatatcatggctagagaataccctaaaaacgtgttatgtttatggaaagatattttcgatccaattaaaagagaaactcttaaaagaaaaacaagaatgtcctatggctacaagtttctaacctaacatacgagtgaagacggattatgatatatactaacaatgtacaccttagagtgatggcattttaagagttgcataatttcaaagctttcactcaagcgctaggttagaattttgtggccccaaataggtaaaaatgtcgttcgataaattaccaattatttattatccttcaattatagcacatttataggatatttatcagtaaattacataagatttagttgtcgtggaataaaatttgtcaataagaagagagagaatgtggttagagctgtagcggtagaacagattttattccctgctcttttgccatactcgagctacatattctggtggtactttgcgaagatttaccatcttagtcctaacactaatatgtaccgaaagttaattaaaacacactcctggattagcattcgggctccggttgtgagtaatcaccagagctgatcgaggtaataatctctagtgacgtcgtcgctgaactccgagtcctcgtggcggctcatctccgagctcttcaagctgatggcgctgtccggccgcgacttcctcgacccggcgcgggccaggctaggcctcggctcgccggcggcgccgtgccgctgcctcggcgcgctctggcaccgcgcacgcgccacggacgacgccgtgtccgccatgtaccgcgggctcacgacgcgccccttcgccggcgacgccgggccgtggtaccccgccgggagcgcggcggcgagccggggcgtgttgtgcgtcgtcttcggctgcgcccgcgcatcgtgctcgtgctcctcggcctggaggtggcgcgacggcggcggcttgtagcagtagaggtgcggcgaggacagcggcaccgaccccggcgtgccgtccggcggcgggtcggcggcgtagcggctcgtgatccgggaagaccggcaccggagctggcacgtgtccatctccacgatcctcgggctgcggtcgaagttgatgtcgccgccgtcggacacccgacggcggtgcaccaccggcaacgtcaatgtctttacccgccctccttgcatttgcacgacaatcctctcctacgtacaaaagatgctcaaaaatttaacttcatctgataaaatcaaggtgatccgaggaggcatcacagtgaaaaatctcacctgttcgacggatttccgcgatgaggccatcttgatggcgcgagaggaggcttggagcctcatgagcgcttgcagcctctgcagagtcgtcgctgcttgcttcctcacaaggtagccacgtaccagagcttgtatcttgacaagcgccttgagagcgcgcaatgccctcctagcctgcatttgcggtggaaaattcaaatttttacagttgcttcgaaaagcaaatcaacagaaacaatatggaagtttttgaactatatgccatgacgactaggcttgtgtccccactgtgcagttacctaagcgtttgcagcaaatcatcactaaacaaaaatatcctaaaatgtggaatttatctatagtaggaagcagattaaacaatgtgcattgtgcaatggctagctactcaacggcaagaaactatcaaacaactgctgccattaacaacagttagtaaagtgaagtcaaatctcctgtccaatataaaaccaggagaatccataccacctactccctccgtcccattttgagtttttgcttgtaacgtttgaccactcgtcttatngaaaantgtttggagttattaattattttatttgtgacttactttattatctatagtactttaagcacaactttttattttttatatttgcaaaaaaaatttgaataagacgagtggtcaaacgttacaagcaaaaactgaaaatcccttatattgtgggacggagggagtattttcaaaaagaagaatctactaaaatcccgtgaacctatccttgcattgattgctaactgaatcgtggaaaaccaaataaaatgtcatttacgaatactaggctaatgttcaaagttcaaacacatgcagcagctgcagaacaaaactcaacattttcaggggaaaaacaagacaccaaaacagtacttgggagacgtaccaggtatcctctgaaggccttctggatcatgacggccgcctccacctcccgttgctggccgcagctgcatggccggacctgcgagagctcgccggcgacgacggcggtgaccgagggcctgcggctgccgtcagcgaaactgctcctcggcttagcgaagctccacctcctcctctccatcggcggcggcgcgacgccaccattggcgcctccggcggcgctgtgctccttccgatccctgtctcctccttccttcttgccggtgagaaccttcttgaaccacctcatcgcgcggcccatggtgaatcaacctatctgcagcacgacgaatgccacgaacagaggcgtcaaaaaaaatgtgtagagagcgtggataaaaggattcaagaacagcagctagaactattactccagtgctgaaacaatggaactaataggagacgcaaagatcaactcgggagttgttgaaagttgaaaaactgtaggcgaacaggggaaagaaggctatagtataccgctatagctcaataaaacagagacgcccacgatttgaaatgagatactccagagtccagatagcagagtggacaagaaaaaagcatggaagcaagaaagcttgggtgaaaaaagggtcttttttcgatggtgaagcagggaagaaacctttttacagagaggggctgctgccgagaacatgggaccgaacagagatggaaaccgaactgaaaaggcctcaagaagcttagctgaaaaaggagaaggcaaagacgtgtaatgtagcgccaaaaacagccgagttggtgggggagatcacagtgctcccctccagctcacgaaacgtgactccctgatgcggaaaaggaccttttcatcagtgaaacccagtacccaccagcccagccagcccagccggttgaactctcccaggcgaagcagcgagccagccggcgattcagagcggaagcagccggcgacgaagtgtgagatagcgagctatcgagccagcccagccaccgcaaccgcagcgacgctcgcaggggaaaagaaaagattccccctgcttgccccctctcgcctaagagtccgagcacaaggcaacaaaaaggctaagcgagaggcaagaccaaccgaagcaaaaaaagacccaaaccccggagggttcaccaccacgcaccgcacgagacagcaaaagaaaaaaagaaaaaccgagatggcaacaagatccaaacggcgtcgctcgcgcagatgcaatcattcgcacggacgcacctcgcctccgcgccgcgcgcgcgcgggggccgagagcccgagatagccgcgcaacaacaagtcacaagttggggggggggggggg

SEQ ID NO: 69645 - DNA, 5936 bp, Oryza sativa
gcttttggagcccgagtctggccgagaactcacgccaagatccgatccggcaaccggctaaaaacaaacgtagtacgagcagtgacgcacgcccaccccacccgcgatggtagcagctcggctaaccccttccacactccacaccagcgcaacgacggaagtgtgtgacgcggatggatgtggtagtacgctgtagcatgtactccctccctccgttcttaaaaaaaagacaaaccatgttttcgtgtccaacgtaaattaaaaagacaagtcacgtataaaatattaatcatattttatcatctaacaacaataaaaatataaattataaaaaaatttcatataagagagacagttaaaattggcaaaaaaaacccagagtttgtctcttttttttttatggagggagcacgagcgctcactgatccggtcaaataaatgtttgtgcctttgtttatcgccttgtgtagggatacggattctaggcctctggaccacagtgggaacgtccgaacgtgaattggttaaggctgtgtttagttcacgctaaaattgaaagtttagtcgaaattgtaacgatgtaataaaaaatttaaaaatttatgtgtgcaggaaagttttgatgtgataaaaaagttaaaagttcaaagaaaaattttagatctaaacacggcctaaccatcgttggcatggaagttgaaccgctcgtatactgtatacttcgactctgtaatgtgtatagtgttataactcacggcaacaagcttgagaaaatggaacaccaaatgtaaagatggcagaaaatggaacaccaaatgtaaagatggcttaattaacgggttgtgcatctgtaactccagaggtgctaagcgttaattatcaaccatgacgggaatgcacatgccttgccttgcgttgtggtccatattcccccggttcagtagtagaagatcacaaatttatttactgttcaaaatacacagccgatggcccccgctggagacgcacgcgtgacgcaagcggcgtgcacgcaagaaattttatgggaggagagtggtacggatgctgaagggaaaaatttctcatacgaattggcacgcttctcgaggctgccgctctgcgtgacgccatcctcccgtcgtggaacacggtttcgacagggcatggccgtcctttcgacagtgcagagcatgtactcctccgtagtagcagatccgtcgaaaacgaaaacggaaaaaaaaaaagaatgagtatctgttgcactgacccgtgggtcccactccatcgtatatgcttctaatcggcgtagctacagaggtggcaaaggagtagtagggtaccaagatactggtatactatggctgtgttgagatccaaagtttggatccaaagtttggatccaaacttcagtcctttttcatcacatcaacctgtcatacacacataacttttcagtcacatcatcttcaatttcaaccaaaatccaaactttgcgtgaactaaacacagcctactagtatcccaaatgggtttatatcatgtactataatgacactgttattatagacaccaacatgtgaggcaataggagagtagaagtgtgggacccacacacctacgctagtgacattatggtagaggatactcatataccccaaacactaccaagacaccaacacgaagagagtacgaacgctagtagggcgttcccagcgcgccttcatggtgttcgaactgaataatcaacaccatgttctccacacaggaaaacccgtgaagatcgatcgtgtagtcaaaactgatcgcccgttctttagcttgaaaaacctgtaaaaagcacatgcacaaatgactgggaagaggagagagagagagatagagtgtgtgtgtgtgtatgaaagctgtggaaggaatcgacagcggttgaagccaccttgacgagtgaagtcaacggggaaatggaggggctcgccggcccgatatgctgcgccgctggacatgatgactcaaagagcagccatatccacttgtccaccggaccacgctacaccgacctcattgcagagatggcatggaagtgtggaagggaggaagatgaggacggatccgtcatcgaccgcttcaatctaccacagagatgttgagcgtcgcggcgaacagcgaaggagaagagaagggtatgatgatggctgttgcaagctcaattatttgtcactcagtcaatccacaacctgctctcggttcatcgctattgggggagtgccggggggctgcctcctccgccaccagggatcgtgcctatcgcggccacccgctcgtcaccacctcagggagcttgtcgcccgtatggatcgaggcatcgctgggagagggtagaggttgtggcgcctgggagatagaggggagaggcagcaccgccaaggagcacatcgctggtgatgggttgatggaaggtgtagggatgccgacgaagtgatgaggagaggcgtagggaaagggagaggtggaaaattttatatttgtttttgaattttaggctgttgagtgtaaaaattggaccacttcataatttgaaaacatgtgatgactgagccacttgcactataagacaaatagatttaggtttaattggatccatgccatataaatatgctgatttagataaataccactataattcgtctattatatttataaccgtgatattaaaatgttacaaaatttgggccatgccactactgtcatgttttccatccatctcagtcttcatcctcatatacacataggacccatctgtcaaattcatcaacttcatttttcctcttatcttcttcttttttttcctctcagctcctcatcgtcgtctgagagaaagtacgagaagtttccgctggcgctcatctgctcctcggataccccatacgcgtgccacatgctggtccgttcgccacggcatgccacgtcgttgtcgccgttacggtatcagctcaccgagtcagccgcggaaaagcccagatccaaaaatgaggtcttgctcccgttgcgcctcgcggtcccgacgcggtgccacccatgctactggtgtaggcgtgggctccctcgttgtcggcgccactgctttcgctttgtggataggcgtgctcaggtgagggggctctctccaggttaatgcagcgatgtgtgtgcattgcgtgtggatttgttcatactgacgatgttgttgtgatagatgtgcaggggatgcgcctcgttgcctctgaagcctcaaccgcggttgggtgtgggtgcggggggtgggggctatgtctacaacaacgagagaagatgagaaaaaaaagaagaagagaggaggatggaagaagaagaatcctatgagtgtcccacatactatagatgaggaagaacacggagatggatggaaaaatgtggcgacagcggcatggttctaattttgtaaaatttcaatagcacggttacgaattggagattatagtgatgacatttatctgaatcggtttatttacaatggcatggatctaattaacccatacatttgagacttgtagcttaatattatgtggtacttgaagcctcctcaaaagtatgcattgcactgctagtggccgtagtagtatacagtagtatagcgctagtcattccctagatgccaacttttgtcgctggtggttggacggcactccgtggcaaccgcgtactctcgtacaagtgctggcgccgtgtcgatcggtttttcgaatccacgcttgcctgcacggagatcctctcgccgagagcaattatgtggtcaccgtgtagctagcgatcgagtactttgctggcgccgtggtacgtaaacaaatttactcctcatgcagtggtacacgctccgttctcgccagaacgaaatctagtcctgcacgaaccgcacgcttttggtgtgtaatggccggaggcagcagcagcagcaacgtagtagtccacactcgcgagcagagtgtaatcaaggctaaaggttaagctacggccataatggcggcgaaggcggaccaaacggcagcgtcgccgagcctgtgaggaatcccggctcgctgacactggcagggagggatcaactggacccccccttggtccccttgcaatgctgcaactgcgagccctgtgcaacgaggtagctagccatttccgtcgcagttctagacctgtggcccgctacgcgtggcattcgagtttttaaccgagagggggacccccaccacccccctgccccaagtgcagtccgcgagccccgtgccgaggctttgggccgactcgccgcgtgcgcgcgtgtgtgggcctcgacggacggtgctgcgcgctgcgtcctccaccgggtccaggcgcattgaagaggttttacggatcggtgcaaagcgtcgggctgtaaatgtgtgttggatcgctgtggtcggcgagacgattgatgcattgatagttcgatcgatacgctcgctgtggcggtgctgcggcctactgactactgtgctggtggctactggaaccatggtaagtactacaagtacgcgatgtgtttgctggtgttgcaggatgtggatttggcagtgaaattacgttgtagtagctgctagtcggggagttactcatcatgtgggtacaatggtactcctgttttgcacctgcacgggtgctcgtaccactccttggttttgggcccggccacgcgttgctgcatgttcttgcccgctggtttgatgcacaagggaggcctcgctgaagtccgagctcgaatatttcacacgaggaaaaagtacaaccaaggtccctcaacttatcataaaaccagatacaaaattatcctcaaatcataaaaccagatatctcgcgtctcttaactaatcaaaaccagtccctcgacggttttaaccccggttttagtctatgtgacagctgagtcagcgcgggacccacgtgggtcccacatgtctttcccctccttttcctcccgcggcgcgccggtgcccgcggagagacgaccccgtcctcttccccagccacgacgcgctccgcttccccgtcgtcgagacctgcttcaccatgtacaccggcggcctctcgtcgagaccgtcgccgccaccaccgcatgggcgaggtcgaagtcgcggacgcggctcgaccggttgcagcacaggcacagcacgagcgccaccacgacggccgagacgagcagcgtgacgaacgccatgggcgccctcttggacgagctcgctccgccgtctgcacacgcttgcacggccggtcggaggtcggcacgtagtagaggtactagttgccgccgaacctgccgcacgtcatcatctcttttccctcctttcccttcctcctctctctctctctctctctctctctctctctctctctctctctctcactcagttttctcctcttgcaggcccgccggtgggtcgggaggaggtcgacggggcgagcagggagaggggaaggtgcggcggctggcgacaggcgacgcgggagcaggccgccgcgccgggtggggaggagactggcggagcagaggtcgcaggcgtggagccgtggagtagggcatcggtggccgacgacggcggaggagcggcgatggcaggaatagtaccgacgggaggggccacgagtcgtgcggcggcggcggcgtgcgctggctctgactcgtgcgtgtcctcgagctcgtggcgccggcgacgaagacggcatcaggggagctagcgatagtcggcgtcgccctgcggctatatgagcccggagctcgctctaatggaagcagaggtggagctccttggatggcgcggggaggccggcgtcggcgtcgccctgtcagaggcatcacggtgcggcaacgtcgagcagtcggcttggcggcggtgggcgagcggtggcgggcaaga

SEQ ID NO: 69646 - DNA, 7582 bp, Oryza sativa
ggcctccccgcgcttcgccgccaccaccaagctgacgccgacgccggatttgtagagctcaccggccaccccgtcgcctgtcgccagccgccgaaccttctcctctccctgctggcatgcgagaggagagagagagagagagagaggagggggaggaggaagggaaaggagggaaaagagatgatgacgtggagggatatgaggggaaagaaatgtgaggccatgtaggtcccacgctaactcataatcgggatcaaaaccgtcgagggaccttctgtgacctgttttgattagttaagggatgcgaaatatctagttttgcggtttgaggataattttgtatctcgatgagaagttgagggaccttggttgtactttttccttcacatgacgagtactaagactggccctggacgataggaagtccagaatacatccttagtgtacacttgattatgggcctcgctatggattaggcatgcctggcctagcaggccactgaaaggaagcccaccgggctgacagtgcagtagttgggcttaaagcatttgtctgttaggctttttacggcatgcgagtacaacattgctcccgttttagcatttgaggttgcaagttatttgtcgttcaaccttaacccaaaagccaagactagcttattgtattttaggtcatgtttaaaattacatgatgaatttgatcattatagtggacttttaatcttcggcctgggtctatggcccaagtgacctgagactttgggtccatctctaagtcaatcgttaatatgtgtggagattatggttaccccatatctacatggcggttatattctagctggatatacggtaccaaatatagatagaatatctttatgaggactcgggttagattctaaacttgtatgtcaagaaaatacccggtatcctagtcggttacgattgtattttatctataattccatattccgttaggatagaaaatacccggtgtcctagtcggttacgattgtattttatctataattccatattccgttaggatatggactgtattttgtaaagaggactccttcccctatataaggagggtccgtgtgcctcttggggggcgattttttttttcaatttatacaatcaataacatactcggcggaatcatccccggacaggagtagggtattacttcttgaataagaatgcctgaacctgtataaaattcattgtctccaaacccatccactttcctagcttgatagccacccccttttattattgccgaaatcttgtttcgacagttggcgcgccaggtaggggtagcgtcaagttctcgccgactaagtgcgatgggtttcgtttctggcatcgacgacttcgcctttcctcccgggcaggcgttccggttcggcagcctcaacttcatcaccaacgacttcggcaagatctctctccttgactcggactcaaaccagtcggggagaaaccaggtcctcgtgccattcggtattccgaactcggccgaggcctactccaagatcatctctcccgagtcggctctaaaccactcggacgagatccaatctactcttccgcgaccggatcaagacgacgggtcctatccctcaatcctgatgaaacttcctgatgatttggccgttgtcttcactgccaagacatctcccactcgaagatctaggcgagctccggcttcggccccgatccaatctagatccagagaggttgacattatactccaacctcttgggacagtctcgacgaaagatttggatggctacctcagctcccccggcgtcagttctcgaccaaccgagatcctcgactacgacgatttcggctaccactatgaccacggcgacctcgacaacttcgacgacagttatgaggataactacacgcccctcttcttcggcgtattcatggctgacaacgaaacggaggaacatcgccaagcccgagaagcggaccaagatcgcgcacggcaagaagctgaacgtcgccgactggaggaagagcgatagcgacaggagcgagaacgactacagcgtgagcaacaagatcgcgaacgaattgcaaagaaggctgaagatcgacggcaacgctccttggaatctgggcgccgagcgagagagctcattgggcaacaagacgtcgatggaacagcggtctttcgcaccccccagcagaacgcggttacagcaatcactctcctcgacaccctcctcaaggaagacgcactcaaccaagccgatcatgttgtcaacatcttgaaccagacgaagaccatgatcgctgcctcggttccagccaactccgcaagcacccgcaccccgactggtagccgagtccctcacttccgatctcatgattatcatcagccaaccctcagtatcatcggcacaggatctagtcacaggagcaggggtcacgacgaacgatttgttcactcgcctcccgaacgtcacagggagcgccgggtcgaacggcctcgctctccacctcaccagcgtcccgtcgacctttgcaacacgatcaaccagcgccgtgcagcacgaggtcaccgccattcaccagatcgctacgacgacgacgtggacggagtagctgccttcactaatgacctgcgttgagtggattggccagccggctttaagccaactggaatcaagaagtatgacggcaccaccaaccctgagtcttggctcaccgtctatggtctcgcaatccgcgcagcaggaggagacagcaaagccatggtaaactatctacctgtggccctagcggactccgcccgatcctggctccacggactatcccgtggcacgatcggatcatgggcggaacttcgtgatcacttcatcgccaacttccagggcacctttgaacgccccggcacacagttcgatctctacaacgtcgttcagaagtctggagaatcccttcgagattacatccgacgcttttccgaacaacgcaacaagatctccgacatcactgacgacgtcatcattgcccatttaaaagggcagtcggtggttacacgcatctctttgtggctatcaacaaattctccaagtggattgaggctaaaccggtcatcacgatcacagcagataaagctagagattttttcatcaatattgtgcatcggtttggggtacctaatcggatcattactgataatggcactcaattcactagcggagcatttaaagacttttgtgaagacttcggcattaaaatttgttatgcctccatggcacaccctatgagtaacggacaagttgagcgcgctaacggcatgatactgcaagggatcaaagcacgagttttcgaccgactacgcccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgatttcggaacttcaacgaggagggctatgaagagggtcgagtagacgacatcaaccgactagaagaagcccgagaagcagctttaattcagtcgactcgatatttgcaagggttgtgccgttatgataatcggaatgttcgatcgcgagcctttttagtcggcgacctggttctgaggaaaattcaaacaacacaggatcggcataaattatctcccttatgggaaggaccgttcataattgctgaagtcactcggccaggttcttatcgactaaagcgcgaagacggtactctcatcaataattcttggaatattgaacaccttcgtcgattttatgcttaggcatcttgcttgtatctttcctatttgactgcttatcaattcaatttgcttacttgatgtatcattgctctgtttgatttcttggcttagtcaatgaggactgaaagttttttaacaacttttgcgggttttaggctcaacaaggtttgacaaaaacttttaagaaatcaggagctaagttaagatatcaagcacagcataaattcatcagtattgtacaaattgtgcctccatcatcattaatcatcaaaatcattggtacattaatcagtatcagttttttcatcatcagacttatcagacctagtcggccgaaggtcgacatcttggaatctctcaactacatcagcagcaattttgtcagccgctttctgcgcatcactgatgaggtcaagagcagcttcttcgctcgtcccgtctgcaaagccatcaatggcatcaatatcaactcttggataaagggatttggtcatcgccaacgccagacttgctcccatactcccagcttctttgatgttcttgaagtaagtatctggagcgactctcagcttgtcgaagatttcggcagcatcaagtgtactcgaaccggcgttattgaaaaacattgcttaaacaattggggtagcagcgttagcaacctcatcccgggttccttcaagttttttgatcttgccaaccaggacgtcgaattgagcttgagatttgatcttgcggtctgcatcaacagattcacattaataagtcagtatatggaggatattggcttttgaggtattgattgttgataccttcaacttcctttaaagccaggtctctttgtctcgctagttctgccttgtcattttccagaatttgaacctgcttctccaactgagatatcttggcagcttgcactacattgattacggttaatcaagattgcaaagataacattatgagtcagttgagcagagtttgtgcgtaccttttgatgagccactcagttcaaaatttgattcctggagctcagcgatccgatccctcagatcatgttcattcttcctggcaagttctttcgcttcgtgcagttgattcctggtagcttcgagggttccgagatgagggactaacctctctaaggttaccgttttggcttcgttcctaagatgaatcctctgcaagacagtttaatgagcacatgaattaaatggcaaacaagatggttgaaatcaagtaccagagggcttacatttacaatacgggttgcttgaccaagtgccttcttcagtaggcataactcttcgtcctctttttgcttatttatcacgatcccttgaggctgcatgttgtcatcccaccacttgaccagaatcggagggcgtgaatcctcagccgcttgtatccggaggatttcttcttcataaccaattattggccctagtgtatccatgaatgaagatgaagcagctaaataaagtctgttggatcaaaatgatttcagatagcgtggctacctgtgatgattcccggtcggggacgagtggactttggtgtcttcacaggagatctggtttctgattcactgtcggcatccttcccgagaggactgttcgtttgagcttcaacctcgggaaccttttggcttggccctgcatccgactggtttccagtcgggggctcctggttagcaccgacttcagcttcggccgactggttcccagtcgggggctcgttgctgggttctacattgtcggttgccggctgattgtcactcggatgatcctcaacagatggcccggtttctttggaagagcttgtgtccatgttagtcgggtcagagtctttcccagacggatctatatcagatggtttcctgcaaatttgattatcagtgttattaccgcaatgggtgcgcatcaatgcaaggaagatcgttatatgagttgcacctggaagacttcctgatctttggcacaggacgactggatgttttcttccatggagtagcctgttttggtagttttttggttgtctctcggtctccaggcctcctgatggtatcatcggcttcgtcgtcacttagaaccagcttcctctttcgagaatctggctggccgactggatgtcacgcccagaaattcccgaatagaattccaagcagaatgtgtattaaaacccccgtccaggaccagccggggtacacaaacgacaatgttgacctacagatccacgtcttacaaacaatataaaggtcttacagaaatgcagcggaaaacaaaagataactggagctaatccttgacttgaactgcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctgacccacgttgcgacaggcccaaccatccacctaaactatccaaattcaacagattacactagggtgagactaatcacggtgaatctggttgaccgcccgtaaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgcgggagggacctcggcgactatctcgaagtacaccggagcgtcggagggatcggaatctagcgacatacaaagcaaacattgcaaacaggctataagactactgaaacagagaacaaaaccatttttaatggactctacatatttttcttgatttactgagacttgaatgggattaaacggagctcggatgaattacatatgaattttagaagattcactgtgtttattactataaaagaaatccttaaataatttattgcgccatattaacca

SEQ ID NO: 69647 - DNA, 2705 bp, Oryza sativa
acgggagggagaggggaaagagcgcgggagacgcggcgcacgcgcgggcgtggctgacgtggcccgggagagacggaggcgtgggcgcggcggcggtttcggcgcggcggcgcgccgggatcggcgggaggtgggagaaagacccgacaggtgggccccacctgtcggcgaccccgagagaggaggcgggcggcggctgccaagctgggccctcggcctgcggccggcccagcaaggaggagggggaggaaggaggggaatgggccggcggcccatccgaaaagaaaaaaagagggaaaaagggagggaaaagaaaaagaaaaaggaaaaggattttccctggaattaaaaattgcactttagtgatttttaattggttaaaattatttctagagctctgaaaattccactaaaaatcctgttaatgcatttcgacatgtagaattcaagaaaaattccacatgtcaaatccgattattgtttgcattgttttcttagggttttatcctgatttcctctgcattttcttggggtcatttgtaatttacaatttggcttgggaggaaaacttcggggtgtgacactggatcagaagcacttggttgagtttcagaccgaattcttggtcctccgctcccttgtccagtttggtggcggggagatcggcgttgagcgattgggggatccgacttcattaaagcaaattcctgggtgtaatatccttcattgttaactgattcaacaagaaaacaagatcatattttgagaaaggttgcagtgtatgaatacgtaccagtggaggagggttgaatgcattgaatggcacaacgggcagcagatgtgagtagctgacaacgatggcgttcgagaagatcttatacatcctttctttcatgaccttgaagtcaagagaatctggatcttcacgatttgggtcatgcttgccgtcaaattcgaaggctgtgcgagatctttctttgattggagctaaccgacacttgataaagtgccgggtgatctgttccccttgaaggccctgttctttcagctttatcatcctctccatcagttctactgcttgtgcagcttcatctcctattggcagtgagttccatgtgtcctggtaaaccgaaggaagacaacagtactcggggagtgcgggctcaggattctgaacatagaaccagtttgcatgccagcctttgtttgaggttttgaagggcatggagaaatatttttggctcaaggttcctctgagttggaaaccagctcccccaacaacgcacggtttgcttttgtttggctggggcttggggaagaagatgcggcggaacaaagcgaaatgaggcctaatgcccagaaaagcttcgcatgcatggataaaattggcaatatgcactatggagtttgggttctagtgatgcaagctaatcccgtagaagttcagaatcccccggaagaatcttgaggttggaagagaaaatccgccatagaagaaatgagcaaataccacgatttcatgtgtatcgggggttgggaatgcctcaccaaatgccggtcgccacccgatgatttcttttgctggaagaacgccgtgcaccaccatctccttcagattatcttccgtcacatcggagggcgcccactgactctcgaagctttctctttcttccgccatgaatgtgaaatggatggtctgatttagttcgagatatggctggaaaaagatggggaatcggagcggtgaatgcggggagaaatttcgtgaagtttttgagggcggattggagcggattgatgaaccctagtttgcccggcgcagttttgcactgtagcaagaaatggggaaaatggcgagagtctcagcgggaagacgaagagacgtttttcacttcggtattattagggtatcgggagtactaatgggcctgggcctgtacagtacttcagcccagtcttatttccagcgtggcccgttgtgatccttagggacttaggcactttttgctttggcaatttgtgttcacaatgatgcgacccaatgctgttaaaatcctttttagtgcggttttataattctttaagaattaacacgatgcaaacaaaaggtgcccaacagaaaggtgttataccgtttttgaaagctttattaggctgcaaaggctgtctgggttgatttgagatgactggtttattaatagtcattcttttaacatgttatatgcttattttggttatggtaagggtcacagcctaggctattggactcattaattaccatgattttctatcttgtttggtgggttattttacgagattttttactcggattcctatcaaacatgtttatttttggaccttttgagtgtttatcactcggcccttcttgtattttttatccttgatatattcaagttgagaaggagtcggctgggtatcttagtaagtaccatgcgtgcttcgctataaaaccactcggttcttgactatatgtttagtttttcaactaatcacatagtcgggggctacacctaattaggtgcatctactcgatgcaccatgttttattttcgccctttgtagtctttgattttagcactcggcaagccggagcaagttgaattgaagcactcggattattgttttttgtttcgagaagactattttggtcaactgcgaaggtctcgggggctactgtggagatt

SEQ ID NO: 69648 - DNA, 8393 bp, Oryza sativa
cgagacaagggagggatttaaattgagatctttggcacaacttagactcaacactcaaggaacgaaattttcgcaattaggatttttgccgaattagtttttaacgtctcacgaaaagcggagcgttacagatccaccccccttacaagaatctcgaccccgagattcgacggtggaccacacacatgaaaccaaaaggggaacttcaaacttcttcttagcttcatactctgcgggtctttctttatctcgagactgcatacttgccacaaaacggtctggtactctgactcacttagcagtctcccttttactgtggctctgatcttgcatgtggaatctgttcttcatctgctctttcaacttgctcgagattcaaaacttttccctttgtttctacttgcacatggttcagacgactttgtccaataggcggtgaggtcaacgaggcagaaccactgtttggtggctttgaactttttggtccagatacgttgggaaggcttgttgttggttgaacttgctttgacttgactttctgagggcagtaccatgaatagtgtctcatctcatggcagatgaaacattcgactcatgccttataaccacgtctttttcaaggtggagggcatggtacggaattgcttccttcaaggcttttattgttgatcactatggtttgctgactagattttgactttgtcgaacgagacgtagaatcagaaccattggaatactgagattctccctgatagtactgcactggcgggtctatctcttgacgcaaaccttctcttgcttgatcctctaaggacattaccttgtgcttcttgtagtcctgcatttctttttctgcatcttctagtaacaaggctttattgaccatgtgctgaaacgttggaaagtcgtgagctaaaggtttcactcgcaatttcgcttccgttccttttagaaaccttttgatcttcttcttatcaatgtccacatcttccggggcatatcgagccaatccgttgaagcgactcaaatactcgttgatgcaagaggatccttgcttgatatttgcaaattcttccttcttcaaatcaattatgctttcagggatgtgtgctaagcgaaaggcttctgcaaactctgtccagatgatggtactagcatctgtatgggtagcacagtagttatcccaccaatttgtggtatgtcttcttaactgatgtacggcataaaagggttttcttctacggagtgcactgcaccaaatttaatttcctttccacatctttgatccagtcattggcttcaatggtctcagttgtttgggagaaccccggtgggcgagatcttaagaattcgttcagtcttgaccgacaattatcttgaaccatatggggttgatgctcttgcgtgtgttgtcgttgcataacaactatattctgaatcattccttgtaatatctgggtttgcatggccatgagtgggcaaaagtccactgttggggggctgatttctgtactgcggcatcattagttgatccagaaacaactgcatgatcacttctcaatctgttgctcatctgctaggctaattgactgatcgggaatttctgactgagctgacccttctttagaaccagggcggttaggggcacggatctgacggatagaacaatgtgccattggcttcagagtgactgagatctgactgaaccagaaatgggataagaaaagaaggaaaacaaaaacactacatcaaaacggttttcgaaatcacagaagacataggtggtgtattccagtcggtatcccaactggtctaacacctgaacacggactaccaaacaaaactcacgcacgcactagttcaccacaactcctaccgagcgggtgacggtactagggtctgcctaccaacgagggcttaactaagactcctagaggcttgagctcacctttcttcaactgggcgtgaagacaggtttactctaggataaaggtcaaaacactcgactagcttctacttttggacacgaaaagatttttcgcaaaactagagctaaaggggacaacgacaccttagctttcacaaatagtttttttttttggtactcaaataatgccatcctattaaggggtttcgatcctagggccaactaatgctctgataccatctctgtcacaccccaatccggcaccgccgcacaacggcacctgataggagcgtgtcgtaggaaaaacggcgcgaaccgcttcctacgaaaccgcgaactcggtaccagtcccaggacatagtgctggtacccacggtgacaaatatgaatcattgcaaatccttagaataaatagaggacttatttaccttaacttaggttgcagctcagacagcccgagaatgcaaccgacgacacggacgaggcgaacaccaacaacagcagctgcagcggaaccaacggtctaacacccaacaccacaggcgacggctgggatccaggacgaaaccctaatcttcgcttcacttcatcttttcttcaagacggaggaactatatatatatttatatagagcaagggtgagtacttacgtactcagcaagccaggggaacttaggtggttaatgcaggcttaaagggaaggctgttattttgcaaacagttttgttttcaagttttcaacaatctaagtgtgtgctttccacaaccagagcgagacaagtctcagcttggtcgggaggtgagaagaacaaatttatttatcaagatttgcacaactcccagagttggcttcaaatctggttttttttcccaaaccaaaccaattttccaaacttcccgataatagtggtccccaaacgaccaatcacttccagggacacccggtcccgctgtcccccggacagctaaatgcttcccaagcattaggtttcccaaaccttaacaccttttcataaaacagggtaaaacaaaaactacgctaaggaatcacctcacatccgcccgtgaccgtgggcacggctgttcgaacagtttgttaacctctgcagagggggtacactttacccacacgacattactaacccgaatcacccagcccgtgtagaatggccacgtctggtgacctaagggctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccccgattagcaatttactcagccaggggcgtcccattccacccgtgtggtcgcactattgtatgctcggatgtaattccaaaggaatcggtccttagatgcgaccgcacaagtattccgcccaggaatggccttgtgtcgcgagttttatttttaaaactcattttctttcacaaggcaccgacccaggcgtcgggttttccaaagcttttgcaaaccaagttttacccaagaagttactcagattttaagtttgaaggcgaccgttgatactcgcacagagtgcacgaatatcgaggcgcaactagatggttacaagggaacatgatataacaattaacaatggaaggatcagatgcaacaagttgggtaggcccaccggtctgcctttcagacggggcaaacaaattaagtgtaatcctatcaatgcataatattttgcaagcaatataattaagttcaaatataggctcagtatgttcaagggtggcttgccttgctcagggtcttcacgaagcttcacgaatcttcaagatatccacgatcgacgaaaatccggtaaccgcaactatgctcaaacaaacaaaaacctaaacaagagaccaagaaaaagaccctatttagactaaataatagtgccattaaatagatctcaattttatggaaatactggaagtggaacggggtcaatcggacgattggatcgagagatacgaattttggaagtttaattagaatttctggcgaaggaagatatttgtggaacaaggggggattgattcatgaaatttatagaaataatattctcaagaatattattgaccgtatctgacgtgcgggaccaaaggaaatgatttataaggaaaatgattcatgaaattttggaatagagaattgttttataggatcaagggaaaaaagatttattaacccacgaaataagataaaatgatttactgaatttatagaagagagaattatttgtggaatattggaaagacattctcaagattatctttgactcattgacgagtggggccaataagaaggtgagagagagagaggagcaattggagggagcaattgcggacttttagctcttcggtgtgtgagcaccggactcggaagagggagtaaaggtaaacttcctttgttttgttaggccgaggaggaaggctggccaatgggccaagcccacgagccaggggagagagggggagggggacgactgaccggctgactgggcaggggcgggcccggtcaatgccacgtgggcagccacgtcggatggggagagaaaaaggggggcgggaatggcatcggacggctcacggcgcgcggcggaatccggcgaacggcggcgagccgaagcgagcgacgaacaccggtggctagaggaggtcaaggcgaaccgattccacggctcggattggggagacgacgcgtgacgacggccggcggcggcggcgaagctcgccgggatgccgacgtggatgcgcgatgggaagggatgcggctcgcgcgctcgggtttagtggacgcggtatggggttgcggcgcacatgcggtgacgcgggacccgacggtcgccgggctgtggctcgcggcggcgccttgcggcggcgggaggggcggcacggcgcgggagcgaggaggaaggtcggcggccagggggaggggttggggaggtcgagggggggcccgaggaaggtggcagcgccgggaatcaaggataggagggaggccgacggcaggggaggcacagcggaagtggccgagcgcggcagcggcggatcgggcgacgcgacgcgagggcgagaggggaggccggcggctgaaacagcggcttggggaggtagcgagggaactcaagaacggcggtggctagaggagtcgccgagagggaggccaacggcggctctcgattgcgcacggcggcggaaacagagcacgcgcgacgcgagctacgcgagtgctgggacagcgggaaagggaggtggggagctcaccgacgggaggtaatggcgtcggcggcgagttgaggatgggaaggccgatggcggcgcatggacgagcagcggcgcacggcgacgaacgcgacgccgaggcggcatcgcgtcacggcgggcgtgccggggaagggaacggaggcgtgcggtggcgcccttggtcgcggcggtggcattcttggccgcggcgaccaagaaggcggcgacgctccggggttggccgcgcgacggcgaccgaggttgagggaggaggcggcagaggacggaccgtgcgacggcgagatgtcgccggacatagagctcgacgcgacggcgaggagttcccatggcggcagggctccgccgcttggggggggaacgaagcaagggagggaggaagcacggggggtgggttttatagagacggagtgggagcggcaaggtcggttcgaggtggccgcggttttctcggcgctcggctggtgttcatgggcgccgcgagaacgagctacggcgaggatgcaaagggtggtggaggcggtggatcgtgtggtggaaatcgaaccgcgagcacgggaggattggcgcggggcgagcgggtgcggtcaaggtgggggcggcgaggcgctgcagcggcgtcagcggctctgccttttgaacaagaagccaaggagtggaggcagggagctcgctacccgggaggggaaaaagcgaaaggaggaggaggaaagggagctttgctccttccggtttgggaggaaagggatgagagcgagccgcgcctcacggttttggatgcatgcggcatggggcgccgggcccgggaggatgacgccggcgacgactgcaaaaggacggggacggtttgaaggcaagcgcggacacggtggtcgtcggggcaggcgacgaccgagggtggcgatggcggcacccaggcggtcggccactcgcacgggtgcgcgggaatcgaaggaggcagccggaattttgggcggcgtcggcgggaagcgacgccgagagagagagagagagagagggggggcgctctctgagggagtcacgtgcggcgcacgtgcgatggagaggctggcgaaagaagaggatgggccgaggatggtttcggcccgagcgagttggagggaggcaaaatagacttttactggaaggtttgatttggagagaagtttgatgtggagattgaatttgaatttaatttgtgtatttgtacacgagggttcaaggtggatccaagggaggggtcaaggaagggcttcaaaagcgggaattttggtattcttgggatggatttatatttggcggcacgaaggattatttcagaggatttcaaaaagggaagatcattattcaaaaatggaacaagggagatagcggtagaatgccatggatagatagatagacagaaaggtaggttgataggtagagggacggatagacagatggattgacagatggatagataaacagatagataggtatagtagatagatagatggatcgatcgatagatagatagatcgagactccgagagagatgggatggaagagaaggaagaggtggatcggaaaaagaaagaaggaatccaacctatgagggaggttaaatagactttcacagagagatttaattgggagattttagagttggagtctagattcgaatttcgaggttgatactcggtctcgggagaataggaaggagtcaaggaagggaacaatattcggagacgagtcaaaaggggatggataattcagagaaagagagtgtaacttgggagtttgagtttgactattcaacgagatatgagggtaaggattttggagagaagtctgaatagaagggttcggacattcgacaaagttcacggatggggttccaggaggggattccgaatagaaggaatcgagcttcgggactacattgggatggtaattttgaggagacgatctttgataacagggtatcgagacaagggagggatttaaattgagatctttggcacaacttagactcaacactcaaggaacgaaattttcgcaattaggatttttgccgaattagtttttaacgtctcacgaaaagcggagcgttacacggttattgcgataactatatgattgtcgtgaaaaaccgtacggttaccacaaagattatcgcggattcaagaaccgagaagatcaccgtacgtgataatcatgataaccgcgcaagttttacaaaccatgctttatagtccatagcatcttcttctctcattttgctttctccctgatatattgttagagcagctttgttagagtatagataactctattggattcaattgttatgataggatatgattagttgtcattgaatctatcagggctccttaagatctaaaccatgtactccctcaaggttcgatacattaatccacaaaatattacaacacatcttctatccatacacgctttcacatatgatcgtttggaccattgaaggaaaattgaaatgacagtagttgtggagtttagtgctaagaaggaaaacaagggaatggagcttgttaactcgccatgggcagagagagaaaaggcaaacaaaagcaccaaagaggatgaatgggctggttcggctgcgatacagccgtctggaaacaatgctccgtgtaagcaaccgtggcaacaaaactgtgttttagtgtctacaccttgcagctgaataggcccaatcataacatagggaagttttgtactaaaggtttatgtgaacaagcttaggcattgatatatcgcctcaacccagggccgtgcacatgggcgtgcgacccgtgcgaccgtacagggcctctaaatttccagggcctcaaaaaatcagcccaaccggagaaggcccatgtattcgtgtgaggccagagcgccagaacccggtacgagttcgcgctttctccgcgcggcaatttcgcgtgcatggtgctttgtattctcgactccgagctccgaggccccacggtgttttgcattctctttcgttttcgtatctgtgacttattcagttcgtctcgagtctcgacgtctcatctcctccgagtaccaggctgccagccggctcatccaatt

SEQ ID NO: 69649 - DNA, 1324 bp, Oryza sativa
gagcgaatagcaacttagcaagcaaccaacaagcaaggcactaggctgatcatgcaaaacaagagttaaaaaaatgtactattcttgatatatcgcatttgctctgcagtatatacattattttagggggcaatttcgtttttgcccccactttcatctctaaattgagtttgcccctactttttagagttttcatttttgcccccacttttttgaactgaaagatgcttttgcccctgttttggatggaggagttaacggtgttaaatatgacatttatgccctctcccaaatctattcattaattgtgtttttgcccctattatgcaatggctttgaatttttttttgtgaatatgtttaaaactaaatgacatatttggacattacaatttggacaaaatttgaatttgaagaaattttggcaaaatttcggcatcattttaacaaaaattgaacaaaatttcaacaacattttacacaatcatatgaagtcaaattgtacctcacaagtatcacaaagcatgacaacataataaccaacaccaatatagcaaagtttagttcataacaagcaccaacatagccaagttcacatcataaccaacataatatcacacattacaggttcaaatcatagccaacatagtaagaagtaattgtccagatcatgcattcaaacaaaagcaccaataaagctattacatatgaggtccaaaccatttagctagcctccctcctcttcctccccttcccctcccaccaccaccaccaccaccaccaccactagcagcaccaccacctccaccaggggcagcagcagcacctgctcttcccctcccaccaccaccagcagcaccacctccacctccacctccatctccattaggggcatcagcagcacctacacctgcacctccccttccccttcccctcccaccaccaccagcaccaccacctccacctccacctccaggggcagcagcagcacctacacctgcacctccccttccccttcccctcccaccaccaccagcaccatgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccttggaaataattttaaccaattaaaaatcactaaagtgcaaattttaattccagggaaaatccttttcctttttctttttcttttccctc

SEQ ID NO: 69650 - DNA, 8396 bp, Oryza sativa
agttctctttgattcaggtgcctcgcattctttcatttccaaaagatttgctgggacacatggattatcggtagtggaacttaaaataccgatgcaggttcatacccctggaaatgatatgaggacagcacactactgtccctcggtgactatagagatcaagagatcaccgtttctatccaacctcatccttctcgaatctaaagacctagatgtcattctcggaatggattggttgaccagaaacaagggagtgattgactgcgcaagccgcaccatcaccctaaccaacgacaaaggggagaagatcaccttccgttccccagcgtcgcagaagtccgtagcgagtctgaagcaggctgctattgagggtcagacagaaacagtggagaaaagttctaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggtgatctttgtggagaagaaagacaagaccaagaggatgtgcgtggattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcatcactcggtatgggttgtttgagtgcacggttatgtcatttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtaacttctggttatcggaggtcaaatttctgggtcacgtcatttctgctcaaggcgtggcagtggatccatcaaatgtggaatcagttacaaagtggaccccaccaaagacagtttctcagatccggagttttcttggacttgcgggctattaccgtcagttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacaaaagacttccaagtctactgtgatgcatctcgccaagggttgggatgtgtgttgatgcaagaaggcagagtggtcgcatacgcttcgcgacagttgcgtccacacgagaccaattatcccactcatgaccttgagttggcagctgtggttcatgctctgaaaatctggcggcactatcttattggcaaccgctgtgaagtttacactgatcataagagcctgaagtacatcttcacccagcccgacctaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgctcgtggatcaagtcagagcagctcaggtaaatgatcctgaaatagctgagctaaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtacaaaaatgtaccaggacctcaaagagaaattctggtgggtcagcatgagaagagagatagccgagttcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacaccacctatactgggaaaaggttggcagagctttatctttcaagaatcatgtgtttgcatggggtacctaagaagattgtatctgatcgaggaagccaattcacttcaaaattttggcagaaactgcaagaagaattggggactcgtttgaatttcagcacggcttatcatccgcaaactgatggtcagaccgaaagggtcaatcagatcttggaagatatgttgagagcttgtgcacttgattttggtggagcctgggataaaagtctgccttatgcggaattctcttacaacaacagttatcaggctagtttgcaaatggcaccgtttgaagcattgtatggccggaagtgtcgtacgccactcttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgttccatgtatctcaattgaagaagtgtttgagggtacctgaggaacaagctagctcagagcacattgacatccaggaagatctgacttatgtggagaagccgattcgtatcctcgagaccagtgagagaaggaccagaaacaaggtgatcaggttttgcaaagttcagtggagccaccactcggaagaagaagccacctgggaaagagaagatgaattgaaggccgcccatccgcacctcttcgccagctcttctgaatctcggggtcgagattctgtttaaggggggtaggtttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcgaaatatgctaacaggatttttagtggaattttcagagccttggaaataattttaaccaattaaaaatcactaaagtgcaaattttaattccagggaaaatccttttcctttttctttttcttttccctccctttttccctctttttttcttttcggatgggccgccggcccattcccctccttcctccccctcctccttgctgggccggccgcaggccgagggcccagcttggcagccgccgcccgcctcctctctcggggtcgccgacaggtggggcccacctgtcgggtctttcccccacctcccgccgatcccggcgcgccgccgcgccgaaaccgccgccgcgcccacgcctccgtctctcccgggccacgtcggccacgcccgcgcgtgcgccgcgtctcccgcgccctttcccctctccctcccgttcgcgcccgcgcccgagatggccgggattcgaaaaccgaatcccgcctctctctcctccccactcccccacgtcggccgtcgaatcccgccgctcccggccacgtccggctccctctccccctttttaagcatcgccgtcctcccctctcgctttttccccatttcgccgacccctcccgtgctccccatcgtccccgcgccgtgcaaccacccaccgccgcttcttcccgctactccggccgccgctagccgtcgctaggctcgccgccgtcttgcgccgtcgccgccgttcgattcgcgtggccgagatccaccccgtccacccctcctccgtcgaagttcatcgccggagccctcatcccctcgcgcacgggtgagcaccacctccaccgccgccttcggccatggtttccgatcgccgtggttcatctccctctctctaacccctcccaaccttttctctaggtcctcccggaacccgtcgccgtcatcctcccgtctctcgtcgttgccgttcgccgtcgctcctccctcgcgccggccgagcccctcggtgaggatcggtctccctctcttcctctctctccctttgccgcgccgcccgccgcgtagcgccgccgctagggtcgctcgcgccgccgcttcggccgccgccgccgtctttgcgccgtccgccgccgcctcccgtcgccggttgccgtcgctggcaaccgtgcgcgcgcgccgccgccctcgccataaccggccggccggcttgaagccgagccgagccaccagccgcgccccctcccgccttgtgccactgtcagtggggcccatgtgccggcgcccctccctctctctcttgagccgctgcccagtgggcccacctgccagccgccccctccctctccccttgtgccgctgacccgcgggtcccgcgtgtcggcgccacccctccttgtgctgacgtcagccctggggtgaattattgcgcaataaatacattaaggcttttctttaatagtaaaaacacagagaatcttctaaaaatcataactaattcatccgagctccgattaagtccattcaagtctcagtaaattcataaaaatgtgtagaatccattaaaaatggttttgtttcctgtttcagtagtcttatagcatgttttgcttgtgtgctttgtttgtcgcgtagatttcgcccgtttcgtcgattcgtggtttctcgaagacgttgctgtggtctcatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagtcatgcttagttcaactagtgcacaaaaggggaccacattaaagcatagacttgattattggtaaaagctttggattagtgccaccgcattggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagtttagcttaatgaactggctagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtaccgtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatattctttgcaattggatttgtttcgggaaaaatttggggttttgcctctttggtttgtgggaaaaatcttggtcgttcattcggatcggatccttaaaattagctcggtctagggttttagaaaaattttatttggagttatatttgacagtcagttggggatttatcgggtgatatgcattaggtcgtgtctatgttcgatggggcaattttatgcgcatcattttccatgcaactagtttatgcattaagctatggtttagtcagtcgcattagtgtctttatccgggttcatgaaaaatgttctatgcataaaaatcatcatgctcggcaagttacttgagtcattcgttgctttatttaatttggttttgagcatgtgttggttcctatccctctgtactctttagatgtcagacctattctccgatcgcaagcgccgctccaagcttcagagtcgccgcccttagctttatcgtcttcttagtctgtttgcgtgctagtttttggtgtttaggtttgttgcttgtgggttagtcggcggtcgatatcatgtgtgagtggtatgacagcctttattaggagttgtgtgcctctttttcagtgttttaatcaagattaagataatggcacttaatttcataagaaagattagtttccgagccatctgttttcttcctttctcttatttctacctatcccctccagatggtgaagacaaggaatgatccccgtgactccagcgacgccaggggcagcgaagagcagaccgatggagctcatgtcagtagtgcatctggcagcagaccatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctctagcaaggaaccatgtcagttacagagtacctgcacgagttcaaccgccttgcgcgctacgctcctgacgacgtgcgcaccgatgctgagaagcaggagaagtttttgtttgggctcgacgatgaattgaccaaccagctaatctccggagtctatgaggactttgagaagcttgtggacaaggctatccgccaggaagagcaacgcaacaaaatagaccgaaaaagaaagacagctcagatcagctttcctcaggggaacaatcagaagcctcgtttcatgacgggacagctaggtgggccttccaccctgatcgtctgtcagcaccatccctatcacccgagtaacttcgacaacgactacaacggtggcagtcacaacaacagtaagcagcacaaccacaactcgactccacccccactaatggcaccagctcagtcagatccgccagctgtgtcagctcagtcagaacaacccaagaagggggctgtaggaaagccaggacactgcttcaactgtggcaagcacggccactttgctggcaagtgt

SEQ ID NO: 69651 - DNA, 21053 bp, Oryza sativa
  unsure (1)..(21053): unsure at all n locations
gtcgacaagattcaccgtgattagtttcacccctagtttagcttaatgaactggctagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtaccgtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacacaccagcacctccacctccacctccattaggggcagcagcagcacctacacctgcacctccccttccccttccccttccccttgtagttccacttgcactagcactaagtaatgcaaaaaattagcaatgacaaaataaacaaaatcagcattggattagttaaaaacaaggaaaaatgctagtagcaatgaatgattcacactgatgtgggtgcatcacttgggtcattgatcccctctcctgttccactttgtgaagatgagagcttcctcttttgacttgctgtgagacctccctggcaatgcttcgctgtatggccaagctcatgacattcactgcattttttccttttactagtgctagcctcatcagaagctcttatcctagccactcttggtcttccaggtttccttctcaacctaggcttcttgattttatagcntagatcaacatgtgcccactcatccttagatgccattggattgaactgtcctgcataagccattttcaacatctctatagagaagcacttatccacaaaatcatccatttgtacctccctattaagctttgcaatgaaagccaaagcatgatcacaaggctttccactcacttgccaagccctacaagtacatgtcctttccttcaaatttactgcatgtgtaatggtgcccacagttacttcaacagttccagacccacatatcaatacctcatggtttttgagggtcttgctttttgcattcagagtgttagtaatagatgggattatcctttcatccattttacaagcaagcttggctcttgacacaaacttgctaatgatcatctttcttatggtgtcatgcaagtcaacaatctgacgatccttgatttttgagacccaactattgaaacattcagagaggttgttattgatgtaatctaccttgcactcctcataaaacttgcttctgctccaaatgtatggatgattgtcatctaaccaggttagggcttcagggcacctctcctttatcttgtccatgtggtaggtgaacttcacatttgtgaagctcttagcagctgcccacatattttgggcaaacagaggaccatggtacttcttcttcatgttcttccacaagtgtctcatacattccctatgttccactcctggatatacatcatctacagccccctctattcctttgcctgcatctgtactaataaccaaacctacaatggtacaaaattgtagttagcaactggaataatatgcaaatgcaacatgaaggatgaaagatgaaagatgtaagaaaaaatacgaacctgtaggggtaccaatagcttccttcaaattttggacaaaccaagtccaactttccttagactctgtctcaatcactccgtaagcgacaggaaatagcctgttattaccatctattgcaacagcggatgccaactgccctctagaccttcctgtcaagtgagtggagtccatggcaatgtatggcctgcatccttgcaagaacccatcaatgcatagtttgagagctactaagaacctcctaaagcacacatcaccattattctcttcagtgtccaacttaactacactgcctggcactgatctcagaagctcatcttgataagtaggcaacaagttatagctgtcatcccacctcacatttatcatgtcaagtgctctctccttgcctccgaaaacccttaaataaggtatattcactgagtatttcttcttcagctcttccttcagtttcttaggtcctaatgaggggtcatcccgcagcaactcaactactcggtcagctacccatttatttgaagccattgtttcaccgcaattattaaaagaaccacaagtgtgctttggtccacttatcttaacctgcagccatagagtgcatagacaaaattcatgttaagtaaggacaaggctgaaattacttaatgcagaaaagaactaaaaaaatacaaatctgaacttaccttacatccaatgtacttgggactagtagatgcaaaaacagccacttgcaaccttgatccgcactcttgcatttggctctaaatcttttcttgtctttcttgataatgtcaaaagcatgatcattcaagatacaatgatgtgtaactgctgacttgcattgattcacatctgggaacaccacaccaacatcaatacatggatcatgaacatcatatgcaaagacagggacatcatcgtcgtcatcctcatcaactatttcttgatcaggatcaaactcagggtcagagcagtcaaattcagaatcaaatgattccgccaagtcagagtcatagctgctatcactctgtgccacaagtgattcggtgtcagagtatatgccctcatcaacaactccgactgcctcctcatcacatggacccctttttttggatttcttggctctctcattagtggctgtcacatttgtggctctctcattagtggctatcacatttgtggctctctcatttgtggctatctcatttgtggctatctcaatagtggctctctcattagtagctatctcacttatggctgccctattcctcactgaaggatgatacctacgttttgtgggtgaaaattgcaatggaccatcaaaatcaattatttgggcatcaatgcatacaacccccttctctaggttcagctgaaaccaatctagcgattggtcatctaatgtaatctcaacagagtcaccatccatagaacaccacaaagtcatgtattgcttagaaccccatatgaagtgttcagctatgaaatttactaattctagcaagccatagttatgcatgtcaacaagttgggttggcgatgttttaccctccatataggtctttgacccttcatctagcaagctgaaaaacgacccaactctaacaactaatttcaactcattgtgatttgtcctacaaatcatagcaacaaaaatatacatttagctaattgttgcatgttacctgtcgatgatatgggcccgggggtatcaggtttagagggaggaggccgccccccgataccacgtggccctcccccgaggggagtcaggcccaaggtggggtggcggccactccttcctcaaagactagtcggaggaggctgccccccgattccacgtggccactccttccccaaagactagtcggaggaggctgcccccccgatgccacgtggccctcccccgaggggagtcaggcccgaggtagggtggcggccactccttcccagagactggatggaggaggctgccctccaatgccacgtggccctcccccgaggggggtcgggcccgaggtagggcggcggccactccctggccgagactagagggagaaggccgccccaagtgccacgtggctccccccagaggggggatcgggcccgagttcgggcggcgaccgccccctcccgtgactagggttcgggctcccccgaccccctctctacgtcaccacgtacagtgggttaggtgtccgcctccaggtgcccacctacccgcatttatggcgtcctgagcggtcgcgccacaccgcatttaatgcggtgtgcagtcgcactcaaccggtctgtgaccggtcgaatgactgatgggacccaagatgtcaggcgcaccatcgcgtgtgtcaggcgacgtgcagcccgacatatcccatcaaataatgatggtgagaggttctcatcctcttatcccaaccggagtcggtcctcccgctctggtcaaagcaaggctcccgtttcccggtgtaataggagctcagaagtcttcacccattaaatggtgactgacaggggcaccccccgtgtcaggcggcaagatttgacaggccccatcatcaagacgacgtgtgcttggcttcccaagtcaggagacaagacatgcatttaatgcaaagattataatacttctccaccggagctaggttaggttgttgggcccatgtggtaaccccttgaggtataaaaggaggtccaggcctagtggtggagggggggacttccgagcgaactggcgcttgggtctcgcaaccccaagcactggtgttctacattcaatcaatcatgcataggagtagggttttacgcttcttagtggcccgaacctgtataaacctctttggtctgatcgtcttggagtggcctaaccccatcaagaccacacagctccgctcaccaagccctcgaatctcacccgctgcccccggccgaactcacaaaggggggcctcacggttccctggtggaggagttcattctccgacacctctggcacgccaggtaggggacgtgttgtgatttttgaggttctttcgagcgccggcgtggtgagtgtcgcaccgccgctacgggggaaggcgcagcatcctcaggagtgtcgcgccaccccaggcagggggcaaggccccccacatccccaccaggtaagcttggctaccatgtctttgtggcgagtcttcggaatgtccgaggacccccaaagctccagccctgcctcaccgagaagtacgatgatggcgccgacccctccgagtccctccagatctgcacggcgatcatagaggcggcggagggtggcgaccgggtcatggcgaacgtcttctccttggccctcaggggccaagcgcggggttggtccatgaacctgctgcagcctcggttcactcctgggaaacatttcacaggggtaaaaaggtagttcactaaatcaaaaattctttattttcttccataaattcagtcccactaacctccatccaaaacaggggcaaacatctctttcagttcaaaaaaaaagtgggggcaaaaacgaaaaccccaaaaagtaggggcaaaatcaatattagagatgaaaatgggggcaaaaacgaaattatcccttattttagctatatttggtacttgatttaggtctcacttagagcattgtacagggcatacaaatttgacggcacagccctgcctcaaccaagctgggactctaacatatgatggacgccaatgctaacggagcattaatggtagtacatgagagtaacttatatagtatatgatccaaaatataagtccctttagccttatatattcccccgttctaaaataatttcattttttatctatcccatacatatcaatacaaaaccccaaaagtctatgatactcccgttttatcaaatttcaatgtaatcatttctctctttatatactcaaaatatatttatactctatttttataaactctgacgtaataatgtctttaaaaaaataaacttattatagggcaaatggaatggaagggtctaaaacgaagttattatgagagggagggagtaattactaccacatatattatgagttataggttaaagataacctgattttgagacatcatctttttttttcttctttgccgagtatatgtgaaagtcaataatgtcgctagttactcctaaattttctaaaagcaacttaaactttagttatgatgaattattggcttggggatattgacttcaaatctaatattgaacgggttccacttaccttttataagaacaatgcgatgcgtgacggtgtgaggctttgtaagatattctatttgttactgacgttgtgtactacgcagtcgtccagaagtcagatgctcaagtcatacgtatagcatttcgcctttatatggataagtatatccaacctagtcagacatagatagggtaacaagcagagtaaaattcatctggatacggtttagaattgagatcctcggcagcgcgcccgtgcggaagtgcatcttgcgcggaaaccatcgtgtctctcggatttgtacgacaccggtgcgtgtcgaatttgtactacggctcagcgggtttccctgagtttcaccgccccaaaaccgcgagcatccgccgttgcacgagccgttggccgttgcgtctccgccgcgtgcgcatgggcgtggctcatctggggaagcggatcctctgactttgggttgcaaagtcacaggcgtgcagttctgctctatccaccgttcgttatcatccgacgatccaaaatcgtccccccagttcctttcttcttcctctgtttccttgctcctatttctgcgtagcttcacggttggccgccatggctgtcactcttggccaacaaagcacacaatttctgccgctcaaaaggtgtagacatgttgttgaaaattttcttttaaggctacagcttctgtcttagtcagattgttgttgcaacaagaaaaatggcattcgattattgttgaagcttctccctttgcatgatcttacccaaagtctaagaccactgaatttgaacatcactttctccagtgaaggactatcatcagtacttaacgagctgacatttcaacgacgcacctggtatcgtgtccccatatcatcaccaagctctattcgcgcaatgatgcggggatgcgtggggtacgaggctaaaagattgccctatagcaagccccttttcgttttctgcatcggccatgatgcgattgaagtttgttgaaagccgacaatggcaaccggccatgaagctatgcaacgaagggagcaaggaacggaggaagaagaaagaaattaggagaatgagtttaaaccgtctgatgataatggacggtggatagaatggaacttcacgctcatgactttgatatgcaaagtcagaggatccgcgtccgctcatctgtcatctcgttcttctcacgtcaggaatctccagagggacccacccggccatccacgtgactagttgtacattttcttaattcccttatcctttgtctgccgtacgccgctgattttttgttacccctaaaaagtctcctttccaagttctatttggactgagactgttacgtgggccccatcgacatggttggcttggaagtacacttccgatcgtataatgaacgtcaacgtgtgcaataaaagatatcttgttgattttgttttggagtgttttcttgttaattggatcacgccgcaccgcacttgtccgtgttggcctcccaaaaatccgttataaattatcttttatctttagaaaaatcactcacctcaaaagataatttataaccaaaagaccaaaaaccaatcgcacaattgtcaagccaaccaccccagatctacttacgacaaacacccaatccaggccgtccattcccaaacaagagcggatctgagccgtacaaatcctgagtgcggatccgcttatggcgcaaaggcgaagggtactcgaggctaccggttaaaacgcccaagtcagtggctctcgtcctcctttctcctacgcggccggagagaggaggggggaagagaggatctcgcagagcgccatagcctcggatccagaagcggaattcggtggaggtctcgggcacctggatcgatcggaggaagggaaggcggagcagcggtgatggggaaggcggcggcggtggggacggcggtggtggtggccgcggcggtcggggtggcggtggtgctggcgcggaggcggaggaggagggacctggagctggtggagggagccgcggcggagaggaagaggaaggtggcggcggtgatcgaggacgtggagcacgcgctgtcgaccccgacggcgctgctgcggggcatctcggacgccatggtcaccgagatggagcgaggcctgcgcggggacagccacgccatggttaagatgctcatcacctacgtcgacaacctccccaccgggtaagcgcctcgattccgatctgatgtctgattcctttcgtttttcgtattatgtttcctttcgtttttagtattatgggtttggaactttgtgatctaaaaagtttggaattgggaaaggtctcgtattgatgcgaatcgttcgggaacaaatctagtagtgacgcgcgtaaccgtgggaatttatctccgtgctctgattaggaccgactgaccttttgatgggatggtaggaaatgtgcgaattctttttatgatgtttgtacgaaaatcagattcccccgaaaattgcgcctagtggtgatccgaagagaatggaactataatctcccatttgatcttcatgtggttttggtgtctcgtattcgtgaattgggattttttttgtacgttccgatcgaagctagatcaatcctagctttgccaaacaatataagccatttgttataactgaaataagttatgtaaccacaaggaaacgcttgctctcggactctgctgaggagagccaaggcaaattggctcataccagtgattgaaggaaaaatgtggagtcgtgggcatctgaaattgcttctcatgcaccaggacgcaggatttcggtgatgggggtacagagttactaaagcatcatgcaatgagaaaaaaaatgaagtgctagtatgtgttattaacacaaacataaatcattgttatagaaaaaaatataaagtagccaagagaaaatgataatactcttgacaaggatgatttttgtgcttgaaaatgattgttttaatttagctgattgtgcatacacatactatacatacatgttatagattatagatcacatttgtttgctaaaacaatttgcggggtaccggattacgaactgtacccctcatgtccttgtgtaaacaggattctacatagaactcaaacaagatagataaattggcctatctaagctaggaaagataggtctcccgtcaacatatcctatcgttctcagatgatcttcggttttgtgatctatagtagatcgtccatttgttcctaatttggctctttaggatttctgattatgatatgtgattaattaatttgatcgtccatttgttcctactttggctctttaggatttctgattatgatatgtgattaattaatttcttgttggtttgatttgttaaggcttcagtgacaggtaattaactaatgtatggcagagagtttctttgcattgtggtttccttgttagcaatctgaccaattagatccatcagtcgagcttatctcatggtatagttggtctggtaataagtttctctgtaacctccacatcgttaagctaaatgtggcaggcacatcctgaaggaagtttcttaaatataatgattcattcttattctatcggatccttctaccagtctgttagaactcactcacccataagcatacaatgtttcctgctgccttcttccaaaagtagtaatttcattctttgatcataatgatttccctttgcagaaatgaacaggggttgttttatgcattggatcttggaggaaccaacttccgcgtcctgcgagtccaactcggtggcaaggagaaacgtgtcgtccaacaacagtacgaggaagtctcaattccaccacatctgatggttggaacttccatggtaagcatttgctgcttgattttaaatttcttggagctgtacattccatgcttgtcttatgtattttctgactattaatgcaggaactgtttgattttattgcttctgcattgtcaaaatttgttgatactgaaggtgatgatttccacctcccagaagggagacagagagagctgggcttcaccttttccttcccagtgagccagacatcaatatcgtcaggaacgctcatcaagtggacaaagggtttctccatcaatgacgcggtaaaagtcaaaaataacttttggacataccctgactagaacacaatcctgatccttctttaaacacatgaattatgtcacaaggttccttgataaagcttgattgaatatggcaatggagtatttcaattagctatttgctacaatctccctttgtgtacattgtaatcaacttaactaggttagtgaaaagaaatatcgaccttgatcaggaagcatatttaatttgaggatctttaatagtactcagtattatgtttgcctggttgatcatatctgtgtgaactgtcaagcatccaataagaataatttgattttgctatattatctcctgaattaggttggcgaagatgttgtatctgagttgggcaaggccatggagaggcagggattagatatgaaaattgcagcattggtaagttaatatatattaatttcgtcaatttcttacttccacactatatctatgctcagctccgttatctgaggcattgataatcatttgtatcctgatgctgcttttggggtattcacatctgatgatgtgatgcaaacattgttgacatgatttaccactgatgttaggttaatgacactgtcggcacattggctggtgggaggtatgcggataacagtgttgttgctgctataatattgggcactggtacaaatgcagcatatgttgagaatgctaatgcaattcctaaatggaccggtttactgcctaggtccggaaatatggttagtgtgtgaataccttatgcttgggattatcattagttgtctatgtcttatagatgatcaatgccaacactcttgaatgttaaccctacttaaaaaaatatgtaaacgtggaattatttggtattctctaggtaatcaacacagaatgggggagctttaaatcagataagcttcctctttcagaattcgataaagcaatggattttgaaagcttgaatcctggagagcaggtattctatccccagtattttcctctccttttagttttagccttttaggtggaccgcattaacttgtatgtattttccaacagatatatgaaaagttgatttctggcatgtatcttggagagatagtgcgaagaatcttgctgaagcttgctcatgatgcagctttgtttggggatgttgttccatctaagctagagcaaccgtttgtactaaggtatatttctgtaccatctctcttttgatcttcattccttccttttgtcatggcaaaagccgttttactttgttgttaactatcatgctggtcaagttttttttttcacgatttctgtgactaccccttggataagagtgcacatgatataaagacgttggcatcgtttccattataatattcgcactgttgataatatacccagatagattatggaaggggaagttgtttgtatatcttgaaattatcatgctaaatcagttagcaaatccatggaaggtgacaaacatacactttgttgttttatccattactactttcttctggttctggttgattctcataattgtgtgcaactagaagttatctagcttggataattagggtggtttggtttttgctcaccagtttttctttatgcttctaacccctcaatcttatgcaactctggtagaattttttataagtatctcaattgttgtatcacaggacaccggatatgtcagccatgcatcatgactcgtcacatgaccttaaaactgttggagctaagctaaaggatatcgtcggggtatgaaatttcttgacccaaagtggatacgcaacatccaacactgttcaatgagtactggttgcttatttatgatttgatcttttattcaggtcccagatacttccctggaagtaagatacattaccagtcacatttgtgacatagttgcagagcgtgctgcacgcttggctgctgctggcatatatggggtcctaaagaagctaggtcgggacaagatgccaaaagacggcagtaagatgcctaggactgtcattgccttggatggtgggctctatgaacattacaagaagttcagcagttgcttagaatcaactctaacagaccttcttggggatgatgtctcgtcttcggtggttaccaagctggccaacgatggttctggcattggagctgctcttctcgcagcctcgcactcccagtatgccgagatcgactagctttaaggatgatcttgatgaatgatgaatcaaactccgtttgtaggttctcatttcccccttcaaaatccacataatactcctggctccccccttgaaatcttaccatctttttttggctattctgagggcaaacataagtgcctctgcagcgggatatagctagtatagcgccaatgagtttggaggttttctaatggcataaaacgttggatggcagtagcagactaacagggaaatggaggcacaggcaatttccattcctgttctgtcagattcttttcccccttaattgatgttgagaaccaagatttttttgctctgtattttctcttcgtaataaagaaggggacataatctaattgctcttgtttgatctcatatatgtatgtgactgcactctcactgtcccaaaattttatagatgcatttacaaagttacaatactcattacatgcaaataactgaaggatggcgaatgtatttgtctggtatctacctgctctcctaactagcgtgccatctctcctagatggtaaccattggatcaggttatacttcttattgaccattgttctcatactatgctgtccaagctgccgttgccgtcgtcgatgcctttggtgtccgaaagctgcttccggcggctgccacccctgatcggcagaaacggcgcgccgtcgccgtcgtactccgccaccttcccgtccacggtgttctggagcgcctgctcgcacctcaccagaatctgcagaacgtccctcattgtcggcctcgtcgccggctgcgcgccggtgcagatgatgccgagcttgaacacgacctcggcgtcgtcgccgtacccggagtcggtgatgcacctgtccaccgcgtcggcgatgctcctgcccgattgcaggtgccgccacgcccactccgccagcgagccgtgctcgccgccgtcgtgggcttccctgccggtgatcagctcgaggagcaccaccccgaagctgtacacgtcgaccttctcgttcaccttcctcgtgtacgcgcactctgcacgagacgatcgtggtcagcacaaggtaagtcgctgtgctaagagaagaaatcaagggagaatcgtgagacgagcagcgaggttggttgaggtgaattaccgggagccatgtagccgaacgatccggcgacggcggtcatggtgtccggcgtcccggcctggaccagcatccgggcgagcccgaagtcggcgaccttggccatgagctcagcgtcgagcaggatgttgctggacttgatgtcccggtgcacgatcggcggcgagcactcgtggtgcatgtagcagaggcccctcgccgcgccgacggccaccctgaccctcgccagccagtccagcggcgctcgccggaccgacggcgccctcgccgtcgcgccaccggccagcaatttgttcccgtggagccacttgtcgaggctgccgttctccatgtactcgtacacgaggagcttcgtctccgcgcgggagaggcagcagaggagcttcacgatgttggtgtggcggacatggccgaggatgtccacctccgaatcgaactcgcgctccaggttcttgtccagcttgccgccggtccatatgcgcttcacggcgacggtgccgccggcgccgccgctgctccggctggcgtacgcgacgcggtacacgcgccccgcgccgcccttgccgatgaggttctcgtcggcgagcccgcgcacaagggaggcctcgctgaagtcgaggggctggaatggggtcatcttccatgccggctctgtccgcgcgagccgcttccgcctcttgatgtcgcggacgacgaagaaggcgagcgccccgatcaagacgacgagggccgcgccggcggcgaggagacccgaccggagacccggcgatacgccgtcggatgccttcgcggcgcacgagcgcaggcccgcgaagttacccgccggcgccgccgatacgcagagaccggggttgccgaggaagctctggtcgtaggcggagatggcgagcgcggccgggatctcgccggtgagctgatttgacgacaggttaagctggttaatcttcagcgatcccagcgacgtcggaataccgccggagagcttgttcgacgaaaggtcgagcagggtgagcaccggcatggagcccaatcccgccggaatatcgccggtgaactggttcctgctgaagttcatctgcgacaagccactgagcgacgcgatgctcaccgggatggccccggagagctgattccttgacaggtccagctcctgcagcaatggcatcccggcggcgaacccgtcaggtatctcgccggagaacaagttgttctcggcgttgaacttctggagcttggtggccgtcgccggaagccggccactgaaacggttgttgtggatgtaaagcctcgtcagattccaatacagcttctccggcaggcttccggtgaggtgtccattgttctgcaggagcacggtgatcagcctcgtctccgtccacagcgccgccggcacctcgccggaaagctcgttgtcctggagctggagactcagcagcgccgggcaagtggcaagactcgccggaattgagccgttcaaccggttgccggcggcggagatgatccacaaccggcggttgtcgcagaccccctccggtattggcccggtgaggtcgttgttgtcgacctcgatgtctctcagaaatggcgagtgcttcccgagctccgccggaatctgaccggtgagattgttctcgaacagcttcattatcaccagcgatggaagctgagcaaggctcgccggtatctcgccggagaagttgttcgtcatcaaggctaagttagttaggttcatcaaacttccaaagctctctgggatcgttccagtcagctggttctcagatatgtcgagataaattaagctcgctgctccaatcttgccattgacgacgacgtcgccggtgagctggttggtgtacaggaacaagtactgcagctttggaatgttccaaatcccaggaggtatgcttccggtgaatgaattctgggacaggtcgagatactccatctccatcatctctgtgacgtagctggggaaatcgccggtgaggttgcactgcgccagccagaccgtcttcaggctcgtcaagttcttgaacgatcccggcagctcgccgggggtgaactgattcacctcgagcttgagcgtctcgaggctagtgagctcgccgagcgccgccgggatcgtgccggtgagctggttgcagttgagggtaaacaccttcaggttcttgagcttcgacaccgccgccggtatcacgccggtgaagttgttgttgttcaaggcgaggtaggtcaggttcttgccgagccggtcaatgtcggcggggagctcgccgccgatactgttcatcgagaggtcgatggaggtgatcgcggtgaggttgtagaggaacgccgggaacacgccgccgacgctggtgttctggaggttgagcaccgtgagcgccgtcagcccgccgatggcgtcggggacggcgccggcgaccgcgacgttggggagggacagcgacgtgacgcggccggtgccgccgccgtcgcaggacacgtacacccagcggcagtgcggcgccgcgtccgtccacgacgcgagcgccgcggggtccccccacgcgcgcttgacctggagcaggagctgcttctcgtcgacgccgccctgctgcgccgcgccgcgccgcgcgacgaggcttggcaggatcgcgagcaggaggaggtggaggtagtaggctttgccgctcgggaatgccatgtcttcgcgtggtttcttggtcgccgccggcgagcgcgtgcgttcactcggtgaggcaagcagccatcgcggactccaccgtgagaaacatgggtgggccatttatatgcagtgtgaacggcacgtgcagacttttcttcctccattatcctgtttggttaaatgattgaatttgttaggaatttaggattagtttttgggtgctgcttgcttggaagtttcagccatgctttcctttataatttgatactagttcaccagttggtggtttagctcatcttttgtttggtttttgctggtcagatggtggcgttgtttgaaagggatatgttctagatggtttgtttatgcagctactactaagttaagttaaggactaagctgagcaacgtgtacgaattgcacagctcgtgacatggtttctttatgggagttttgcgatcttttcatgatcaaggtacgacaatatgctccgttggcttggactgtagcatgtgccggcacattactctgccgtcggatgaatggtcaaactattcggaagcacagaggtgtcgatcacttgcgacaaagaggagtggaagatgttgcagatcgcgcgatcttattgctatcacccatggccaccaataatttaaacatctaattttgctccactggccgtattgtcgctgttgaaaccatttcttttagtatatcttcaaaccgattagaactagtatcacactatttattagtcttcaaagaaaaagaaaactattacgagagtcgagattataaccggtcaagcacggcaagtaaatttaaagtggaagcaattagcaaatgatgataagctttttgtttccactgattttacagggggatcatccacctgaggccgggaatgtgagtcgtcagcacgaggtcacgggttcagggtgagttgggcccacgatgtcagtgtcacatctagatgtactcgtgcacaaatccctggtctaaagttgagtcaaacagaaaagtcttagataatgatgtggctctggcgcctctgggttgtctttaaactctttgtggtcattcgttgactagtcgtaggcctgaaacggtaagtgaaagggagcataagatactgcactcaataccacacgtgcatacagtatatagtcggtatatatggataaataccacagtgaaaagtttatccggtttcttcacttctagaataccgagtatagctttggatactccgtttttttttttaacctgaaaatgcacaccgtataggtgctcgatgacaatgctggcagcgacaggaaatgcttctggatgatgcagctgtgcagcccattgacccgtctcccacagagagatcccagcttcgatctcagccgcacgttcggtgatccagtggctagcgatgagtgagagtggccacgaaggaaaggagcaggaagtctcatgtgcaacgtcagaaactgaagaaaatttcaaagagcccggctcgcctttgctgactgtggacttgtgcgtagactagcttcagaaaaacacataaaggatgtcactctgatgcccactgtctgtacaactcctactacctaccagcacattgttgcgttttatattgctaaacattagtactaactattctggcagtaagtccatgattagtctgagttttggtgtagtaggctaggacattgtagactctgaaactcgttgtgttgcagaattcaccgcttagcacactgtccgcaaaggaaaaattgcgctgcagatgtagcgaatttggtttttcgttaagagttcggcactactctgtcagttccttctgtactgaaacttcaacgacttttttgagttttgagtaaaaaggttgtggacagagatgcaagctactgtatggtccaagtgtacccgaagactatatgattgattcgcttccagagagtaacagcttgtgtttttgacttttgagaaaaccgcacgcgagatccagacagggattgtaaccatcaagattctagaacggcactatctgctagatgctactcctcgatttcacaaggcttcagatgttgatatgaggacaggtcactaacaagaattcatcgttctgaaagaaacaccttctagtcctagaatcaaaattcagattttaagcctcgcttcacagtttttctagaagcccgtagaattgatcaggatgtgctcaagcccagttgagcaaggcaagtaatgggcggacggcggatttttcctgattattagctttctctgcaggacattcagcatttagcactttggtaataggaaattaatatccaatttcctggggtctagaattttggactaataatattacagtgcagttcataataccatcatgacagcatgctggacgccttcactcatacgaaattgtccaaagagaagcattatcgcatcatgacagcgtgctggacgccttcacctacgaaattatccaacacaagcatcaaattctgaaatatatatagcaaaatctgaaattgtgcagctctaacatgcatgacgaattgtttgctgcaacatgtcaaatttctactcctacctgtaagtgacaaaaatatctgttacatacgtatttattagtgtagatcttctaatgtgagcattgcaagcgaagagaaacacgctggggttagttaacatggataatccctcaagccattacggccgtagtggccaaattcgtcttcgtgctccaggtacccgcgcgcgaacttgcccgggctcggatggacgacgtcggagtagtggtagcacatcttgcagacgctctccgccaccatgtgcccgcacgggaactcgccgatcaccttcctcttcagccagtggtgcgtcacgcggaggccgcggcggcacgtcttgcagacgcagtcccacctgccgctccggcgaggggtcgcccaccggcggatgacagggattctggcgaggaagccgccgaccggctcgtccggcatcgggatgcacgtgatgacgccgaggtagtcgtcgccggacatgtgctcgaagaagaagagcgtccgcgtggcggggaggacgaaggcgaggcagcggcgccattgccgccggcggcggcgagccacgaagttgccgtgcgtccaggcgccggtgctgcagtgcgagcgggacagcgtcacgtcgccgccgggtgcgaggtcgtgctcgtcgcccgggtgcagggcgttgtagtggtccaggcactcccgggcgagccgctcgttggatcgcttctccctgagggcggcggcgacgcggtcgtacgcgcggcggatggggtgctccactggcgtgtttcgtcgcgaccatagcgctgcctcctcgtcgtcgtcgatcatggctctgctcctgccgccgatcagggcctcgccgagggatcgcgcgacgcgatcgaccggtgaatccgggagcccttcatcattgtgggcttcggtttcggccttgatagttttggtgggctggatatttcggggcccaaaactgctagttttttttcctttttgggctagaaggggagccgcgcgcgcacggcacacacccccgtgcgctgccggcggtcttcccgccgatcagctcccgctccggtcgacaccaccattgccccgatccggatgttcggttctggttagacacttgtctacggcgcattgcacactagtgaccgatccgtggactctgcgcgtcatgagaaatttggatacatgccatcatcaaaagtaggcttcgccgaaatgccgttgtaaaaattccaatttgatttcgtggaatgctatttccaacttaggggccgatgccagaatgacatttcgaaatttcttccaaattaaaatggtaacccaattttcctcacatatgcccataccgaaatgcctctagctaatttatcctctcgctccccactttgtctggcgaccggtggtgatcgacgccgttcatcactgcaggtagcctgtcctctccatactagctccactcttccaatgctggactctctactatcttagatctctttcctttgctagaaagttttttttttttgaacgactcgcacgagacggtgcgaagttctattgatagagcaggaaaaaattacaagattacaaccaaatataccaccacccacacggcgacatcgccaacaacaagcccaggagaaggctaacaccggaccggccgctgctaagcgtgaccgaccgccactagaccaacaaagggacacatgcgagattgcccctataggatgccaaaacaacgtcttcaagaagagaagcgacggaaaaactgctgccgtcgtctgtcaagacttaaaagagccaagactgggctttcgctcggcaatcatccttgaggggtgagacagcgcaacaactccctcaggacatcgttgtcagtccgaccaaggctggactgggttttcacccaccgttcaccacctgtgaatccacggctgacgcactgatgctccaccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69652 - DNA, 1024 bp, Oryza sativa
ttagattgttgaaaacttgaaaacaaaactgtttgcaaaataacagccttccctttaagcctgcattaaccacctaagttcccctggcttgctgagtacgtaagtactcacccttgctctatataaatatatatatagttcctccgtcttgaagaaaagatgaagtgaagcgaagattagggtttcgtcctggatcccagccgtcgcctgtggtgttgggtgttagaccgttggttccgctgcagctgctgttgttggtgttcgcctcgtccgtgtcgtcggttgcattctcgggctgtctgagctgcaacctaagttaaggtaaataagtcctctatttattctaaggatttgcaatgattcatatttgtcaccgtgggtaccagcactatgtcctgggactggtaccgagttcgcggtttcgtaggaagcggttcgcgccgtttttcctacgacacgctcctatcaggtgccgttgtgcggcggtgccggattggggtgtgacaaaccgtcttaccgtgggatgacaataaccccatccaaaacgattcggtgaattgtgctatggaggctccttgacagttgatgtcggcatgtgcaagcctcatcgctgcttttatacttggctttcgcattgcaccgatgctattgctagctgcaatggttgatcggagcaagctaatattcagaggaagaatgaatagaaataattgggaacaaaattggcatagacaaagttatttaaaattaaaataacatattgtccaaacaagatttcggcaataataaaatagggtggctatcaagctaggaaagtggatgggtttggagacaaggaattttatacaggttcaggccttcttattcaataagtaataccctactcctgtccggggatgattccgccgagtatgttattgattgtataaactggaaaaaaaaatcgccccccaagaggcacacggaccctccttatataggggaaggagtccgctttacaaaatacagtccatatcctaatgga
